United States Patent 11,446,398 (REGULATED BIOCIRCUIT SYSTEMS) - sequence listing, part 4

SEQ ID NO: 10264 - protein, 1314 aa, Homo sapiens
  Payload ID: 2059;
  Gene Symbol: CADPS;
  Gene Name: Ca++-dependent secretion activator;
  Uniprot ID:  Q9ULU8;
  ENSP ID: ENSP00000283269
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEGKKREMYEHPVFCLASQVMDLTIQNVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 10265 - protein, 1274 aa, Homo sapiens
  Payload ID: 2059;
  Gene Symbol: CADPS;
  Gene Name: Ca++-dependent secretion activator;
  Uniprot ID:  Q9ULU8;
  ENSP ID: ENSP00000350632
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 10266 - protein, 1353 aa, Homo sapiens
  Payload ID: 2059;
  Gene Symbol: CADPS;
  Gene Name: Ca++-dependent secretion activator;
  Uniprot ID:  Q9ULU8;
  ENSP ID: ENSP00000373215
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENQKDAENVGRLITPAKKLEDTIRLAELVIEVLQQNEEHHAEPHVDKGEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 10267 - protein, 190 aa, Homo sapiens
  Payload ID: 2059;
  Gene Symbol: CADPS;
  Gene Name: Ca++-dependent secretion activator;
  ENSP ID: ENSP00000417568
  MOD_RES (1)..(1): Any amino acid
XKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTKPGMDVADAYVTFVRHSQDVLRDKVNEEMYIERLFDQWYNSSMNVICTWLTDRMDLQLHIYQLKTL

SEQ ID NO: 10268 - protein, 240 aa, Homo sapiens
  Payload ID: 2059;
  Gene Symbol: CADPS;
  Gene Name: Ca++-dependent secretion activator;
  ENSP ID: ENSP00000417827
  MOD_RES (1)..(1): Any amino acid
XADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNSQQMHVYLSGLPPNTDPEGSKTPSPPEPEAKKDTKKESKKRKDSKTQANQELKRPDGIGTVTVEEKERFEEIKERLRVLLENQITHFRYCFPFGRPEGALKATLSLLERVLMKDIVTPVPQEEVKTVIRKCL

SEQ ID NO: 10269 - protein, 311 aa, Homo sapiens
  Payload ID: 2059;
  Gene Symbol: CADPS;
  Gene Name: Ca++-dependent secretion activator;
  ENSP ID: ENSP00000418110
  MOD_RES (1)..(1): Any amino acid
XNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENQKDAENVGRLITPAKKLEDTIRLAELVIEVLQQNEEHHAEGKEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPV

SEQ ID NO: 10270 - protein, 457 aa, Homo sapiens
  Payload ID: 2059;
  Gene Symbol: CADPS;
  Gene Name: Ca++-dependent secretion activator;
  Uniprot ID:  Q9ULU8;
  ENSP ID: ENSP00000418736
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTVIRRNRREQLPHSAI

SEQ ID NO: 10271 - protein, 345 aa, Homo sapiens
  Payload ID: 2059;
  Gene Symbol: CADPS;
  Gene Name: Ca++-dependent secretion activator;
  ENSP ID: ENSP00000418889
  MOD_RES (1)..(1): Any amino acid
XLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEFAKMWHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 10272 - protein, 212 aa, Homo sapiens
  Payload ID: 2059;
  Gene Symbol: CADPS;
  Gene Name: Ca++-dependent secretion activator;
  ENSP ID: ENSP00000439528
QDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFSGLKDADRAQKHGMDEFISSNPCNFDHASLFEMVQRLTLDHRLNDSYSCLGWFSPGQVFVLD

SEQ ID NO: 10273 - protein, 222 aa, Homo sapiens
  Payload ID: 2059;
  Gene Symbol: CADPS;
  Gene Name: Ca++-dependent secretion activator;
  ENSP ID: ENSP00000482556
MFNVMVDAKAQSTKLCSMEMGQEFAKMWHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 10274 - protein, 1344 aa, Homo sapiens
  Payload ID: 2059;
  Gene Symbol: CADPS;
  Gene Name: Ca++-dependent secretion activator;
  ENSP ID: ENSP00000484365
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNSQQMHVYLSGLPPNTDPEGSKTPSPPEPEAKKDTKKESKKRKDSKTQANQELKRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 10275 - protein, 1194 aa, Homo sapiens
  Payload ID: 2060;
  Gene Symbol: CADPS2;
  Gene Name: Ca++-dependent secretion activator 2;
  ENSP ID: ENSP00000325581
MARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLSGKDADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEGPAEKETETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 10276 - protein, 1294 aa, Homo sapiens [sequence omitted]

SEQ ID NO: 10277 - protein, 899 aa, Homo sapiens
  Payload ID: 2060;
  Gene Symbol: CADPS2;
  Gene Name: Ca++-dependent secretion activator 2;
  ENSP ID: ENSP00000380833
  MOD_RES (1)..(1): Any amino acid
XEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 10278 - protein, 1296 aa, Homo sapiens
  Payload ID: 2060;
  Gene Symbol: CADPS2;
  Gene Name: Ca++-dependent secretion activator 2;
  Uniprot ID:  Q86UW7;
  ENSP ID: ENSP00000398481
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLSGKDADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 10279 - protein, 1255 aa, Homo sapiens
  Payload ID: 2060;
  Gene Symbol: CADPS2;
  Gene Name: Ca++-dependent secretion activator 2;
  Uniprot ID:  Q86UW7;
  ENSP ID: ENSP00000400401
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEFGSQWQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 10280 - protein, 490 aa, Homo sapiens
  Payload ID: 2060;
  Gene Symbol: CADPS2;
  Gene Name: Ca++-dependent secretion activator 2;
  ENSP ID: ENSP00000419418
  MOD_RES (1)..(1): Any amino acid
XYTRLTEYAKIEGPAEKETETMNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 10281 - protein, 1301 aa, Homo sapiens [sequence omitted]

SEQ ID NO: 10282 - protein, 1223 aa, Homo sapiens
  Payload ID: 2061;
  Gene Symbol: CACHD1;
  Gene Name: cache domain containing 1;
  ENSP ID: ENSP00000290039
MRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRMALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 10283 - protein, 758 aa, Homo sapiens
  Payload ID: 2062;
  Gene Symbol: CACTIN;
  Gene Name: cactin, spliceosome C complex subunit;
  Uniprot ID:  Q8WUQ7;
  ENSP ID: ENSP00000221899
MGRDTRSRSRSAGRRGRRRQSQSGSRSRSRSHGRRNRRRREDEGRRRRRRRSRERRSDSEEERWQRSGMRSRSPPRPKWHSRDGSSQSDSGEEQSRGQWARRRRRARSWSPSSSASSSASPGRSQSPRAAAAALSQQQSLQERLRLREERKQQEELMKAFETPEEKRARRLAKKEAKERKKREKMGWGEEYMGYTNTDNPFGDNNLLGTFIWNKALEKKGISHLEEKELKERNKRIQEDNRLELQKVKQLRLEREREKAMREQELEMLQREKEAEHFKTWEEQEDNFHLQQAKLRSKIRIRDGRAKPIDLLAKYISAEDDDLAVEMHEPYTFLNGLTVADMEDLLEDIQVYMELEQGKNADFWRDMTTITEDEISKLRKLEASGKGPGERREGVNASVSSDVQSVFKGKTYNQLQVIFQGIEGKIRAGGPNLDMGYWESLLQQLRAHMARARLRERHQDVLRQKLYKLKQEQGVESEPLFPILKQEPQSPSRSLEPEDAAPTPPGPSSEGGPAEAEVDGATPTEGDGDGDGEGEGEGEAVLMEEDLIQQSLDDYDAGRYSPRLLTAHELPLDAHVLEPDEDLQRLQLSRQQLQVTGDASESAEDIFFRRAKEGMGQDEAQFSVEMPLTGKAYLWADKYRPRKPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRR

SEQ ID NO: 10284 - protein, 758 aa, Homo sapiens; identical to SEQ ID NO: 10283
  Payload ID: 2062;
  Gene Symbol: CACTIN;
  Gene Name: cactin, spliceosome C complex subunit;
  Uniprot ID:  Q8WUQ7;
  ENSP ID: ENSP00000248420

SEQ ID NO: 10285 - protein, 758 aa, Homo sapiens; identical to SEQ ID NO: 10283
  Payload ID: 2062;
  Gene Symbol: CACTIN;
  Gene Name: cactin, spliceosome C complex subunit;
  Uniprot ID:  Q8WUQ7;
  ENSP ID: ENSP00000415078

SEQ ID NO: 10286 - protein, 117 aa, Homo sapiens
  Payload ID: 2062;
  Gene Symbol: CACTIN;
  Gene Name: cactin, spliceosome C complex subunit;
  ENSP ID: ENSP00000464898
KPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRR

SEQ ID NO: 10287 - protein, 758 aa, Homo sapiens; identical to SEQ ID NO: 10283
  Payload ID: 2062;
  Gene Symbol: CACTIN;
  Gene Name: cactin, spliceosome C complex subunit;
  Uniprot ID:  Q8WUQ7;
  ENSP ID: ENSP00000465751

SEQ ID NO: 10288 - protein, 141 aa, Homo sapiens
  Payload ID: 2062;
  Gene Symbol: CACTIN;
  Gene Name: cactin, spliceosome C complex subunit;
  ENSP ID: ENSP00000466600
  MOD_RES (1)..(1): Any amino acid
XKYISAEDDDLAVEMHEPYTFLNGLTVADMEDLLEDIQVYMELEQGKNADFWRDMTTITEDEISKLRKLEASGKGPGERREGVNASVSSDVQSVFKGKTYNQLQVIFQGIEGKIRAGGPNLDMGYWESLLQQLRAHMARAR

SEQ ID NO: 10289 - protein, 291 aa, Homo sapiens
  Payload ID: 2062;
  Gene Symbol: CACTIN;
  Gene Name: cactin, spliceosome C complex subunit;
  ENSP ID: ENSP00000467149
  MOD_RES (1)..(1): Any amino acid
XKQEQGVESEPLFPILKQEPQSPSRSLEPEDAAPTPPGPSSEGGPAEAEVDGATPTEGDGDGDGEGEGEGEAVLMEEDLIQQSLDDYDAGRYSPRLLTAHELPLDAHVLEPDEDLQRLQLSRQQLQVTGDASESAEDIFFRRAKEGMGQDEAQFSVEMPLTGKAYLWADKYRPRKPRFFNRVHTGFEWNKYNQTHYDFDNPPPKIVQGYKFNIFYPDLIDKRSTPEYFLEACADNKDFAILRFHAGPPYEDIAFKIVNREWEYSHRHGFRCQFANGIFQLWFHFKRYRYRR

SEQ ID NO: 10290 - protein, 130 aa, Homo sapiens
  Payload ID: 2062;
  Gene Symbol: CACTIN;
  Gene Name: cactin, spliceosome C complex subunit;
  ENSP ID: ENSP00000467788
DLAVEMHEPYTFLNGLTVADMEDLLEDIQVYMELEQGKNADFWRDMTTITEDEISKLRKLEASGKGPGHRGQNPRWWPQPGHGLLGEPPAAASCPHGTGPVSTRLRERHQDVLRQKLYKLKQEQGVESEP

SEQ ID NO: 10291 - protein, 882 aa, Homo sapiens
  Payload ID: 2063;
  Gene Symbol: CDH1;
  Gene Name: cadherin 1, type 1;
  Uniprot ID:  P12830;
  ENSP ID: ENSP00000261769
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 10292 - protein, 821 aa, Homo sapiens
  Payload ID: 2063;
  Gene Symbol: CDH1;
  Gene Name: cadherin 1, type 1;
  Uniprot ID:  P12830;
  ENSP ID: ENSP00000414946
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 10293 - protein, 537 aa, Homo sapiens
  Payload ID: 2063;
  Gene Symbol: CDH1;
  Gene Name: cadherin 1, type 1;
  ENSP ID: ENSP00000454782
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITFSSCYWNRDTSADPV

SEQ ID NO: 10294 - protein, 414 aa, Homo sapiens
  Payload ID: 2063;
  Gene Symbol: CDH1;
  Gene Name: cadherin 1, type 1;
  ENSP ID: ENSP00000458139
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVCMVPGKMQKLASSQLFIPLSPGLGF

SEQ ID NO: 10295 - protein, 155 aa, Homo sapiens
  Payload ID: 2063;
  Gene Symbol: CDH1;
  Gene Name: cadherin 1, type 1;
  ENSP ID: ENSP00000463170
  MOD_RES (1)..(1): Any amino acid
XTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTEPL

SEQ ID NO: 10296 - protein, 647 aa, Homo sapiens [sequence omitted]

SEQ ID NO: 10297 - protein, 647 aa, Homo sapiens
  Payload ID: 2063;
  Gene Symbol: CDH1;
  Gene Name: cadherin 1, type 1;
  ENSP ID: ENSP00000480664
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNLASQSIGITDMSHCTCPAPQLPAIF

SEQ ID NO: 10298 - protein, 903 aa, Homo sapiens
  Payload ID: 2063;
  Gene Symbol: CDH1;
  Gene Name: cadherin 1, type 1;
  ENSP ID: ENSP00000481063
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVWYLARCRNWHPHSCSYPCPLGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 10299 - protein, 788 aa, Homo sapiens
  Payload ID: 2064;
  Gene Symbol: CDH10;
  Gene Name: cadherin 10, type 2 (T2-cadherin);
  Uniprot ID:  Q9Y6N8;
  ENSP ID: ENSP00000264463
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 10300 - protein, 436 aa, Homo sapiens
  Payload ID: 2064;
  Gene Symbol: CDH10;
  Gene Name: cadherin 10, type 2 (T2-cadherin);
  ENSP ID: ENSP00000425653
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRQSQRDNTRGCFCENFGC

SEQ ID NO: 10301 - protein, 796 aa, Homo sapiens
  Payload ID: 2065;
  Gene Symbol: CDH11;
  Gene Name: cadherin 11, type 2, OB-cadherin (osteoblast);
  Uniprot ID:  P55287;
  ENSP ID: ENSP00000268603
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 10302 - protein, 693 aa, Homo sapiens
  Payload ID: 2065;
  Gene Symbol: CDH11;
  Gene Name: cadherin 11, type 2, OB-cadherin (osteoblast);
  Uniprot ID:  P55287;
  ENSP ID: ENSP00000377711
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLGCPSLMEPPSPREDMRLLYLGFQLMLFSYVKVNRRFCLLGVFIKLPFLYVVATESPTTLTSL

SEQ ID NO: 10303 - protein, 53 aa, Homo sapiens
  Payload ID: 2065;
  Gene Symbol: CDH11;
  Gene Name: cadherin 11, type 2, OB-cadherin (osteoblast);
  ENSP ID: ENSP00000455120
MKENYCLQAALVCLGMLCHSHAFAPERRGHLRPSFHGHHEKGKEGQVLQRSKR

SEQ ID NO: 10304 - protein, 70 aa, Homo sapiens
  Payload ID: 2065;
  Gene Symbol: CDH11;
  Gene Name: cadherin 11, type 2, OB-cadherin (osteoblast);
  ENSP ID: ENSP00000455420
MKENYCLQAALVCLGMLCHSHAFAPERRGHLRPSFHGHHEKGKEGQVLQRSKRGWVWNQFFVIEEYTGPD

SEQ ID NO: 10305 - protein, 34 aa, Homo sapiens
  Payload ID: 2065;
  Gene Symbol: CDH11;
  Gene Name: cadherin 11, type 2, OB-cadherin (osteoblast);
  ENSP ID: ENSP00000455697
MKENYCLQAALVCLGMLCHSHAFAPERRGHLRPS

SEQ ID NO: 10306 - protein, 222 aa, Homo sapiens
  Payload ID: 2065;
  Gene Symbol: CDH11;
  Gene Name: cadherin 11, type 2, OB-cadherin (osteoblast);
  ENSP ID: ENSP00000455779
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALP

SEQ ID NO: 10307 - protein, 22 aa, Homo sapiens
  Payload ID: 2065;
  Gene Symbol: CDH11;
  Gene Name: cadherin 11, type 2, OB-cadherin (osteoblast);
  ENSP ID: ENSP00000456110
MKENYCLQAALVCLGMLCHSHA

SEQ ID NO: 10308 - protein, 65 aa, Homo sapiens
  Payload ID: 2065;
  Gene Symbol: CDH11;
  Gene Name: cadherin 11, type 2, OB-cadherin (osteoblast);
  ENSP ID: ENSP00000456772
MKENYCLQAALVCLGMLCHSHAFAPERRGHLRPSFHGHHEKGKEGQVLQRSKRGWVWNQFFVIEE

SEQ ID NO: 10309 - protein, 670 aa, Homo sapiens
  Payload ID: 2065;
  Gene Symbol: CDH11;
  Gene Name: cadherin 11, type 2, OB-cadherin (osteoblast);
  ENSP ID: ENSP00000457812
MAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 10310 - protein, 62 aa, Homo sapiens
  Payload ID: 2065;
  Gene Symbol: CDH11;
  Gene Name: cadherin 11, type 2, OB-cadherin (osteoblast);
  ENSP ID: ENSP00000484650
  MOD_RES (1)..(1): Any amino acid
XMSVSEAAVPGEEVGRVKAKDPDIGENGLVTYNIVDGDGMESFEITTDYETQEGVIKLKKVS

SEQ ID NO: 10311 - protein, 794 aa, Homo sapiens
  Payload ID: 2066;
  Gene Symbol: CDH12;
  Gene Name: cadherin 12, type 2 (N-cadherin 2);
  Uniprot ID:  P55289;
  ENSP ID: ENSP00000371689
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 10312 - protein, 794 aa, Homo sapiens; identical to SEQ ID NO: 10311
  Payload ID: 2066;
  Gene Symbol: CDH12;
  Gene Name: cadherin 12, type 2 (N-cadherin 2);
  Uniprot ID:  P55289;
  ENSP ID: ENSP00000423577

SEQ ID NO: 10313 - protein, 754 aa, Homo sapiens
  Payload ID: 2066;
  Gene Symbol: CDH12;
  Gene Name: cadherin 12, type 2 (N-cadherin 2);
  Uniprot ID:  P55289;
  ENSP ID: ENSP00000428786
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 10314 - protein, 794 aa, Homo sapiens; identical to SEQ ID NO: 10311
  Payload ID: 2066;
  Gene Symbol: CDH12;
  Gene Name: cadherin 12, type 2 (N-cadherin 2);
  Uniprot ID:  P55289;
  ENSP ID: ENSP00000480493

SEQ ID NO: 10315 - protein, 760 aa, Homo sapiens
  Payload ID: 2067;
  Gene Symbol: CDH13;
  Gene Name: cadherin 13;
  Uniprot ID:  P55290;
  ENSP ID: ENSP00000268613
MKTPPGASSRTKCSRELRSFCAFSCPRAKQPTCTAWFPQQEHPSENGPQMPGRDPPAASTMQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 10316 - protein, 674 aa, Homo sapiens
  Payload ID: 2067;
  Gene Symbol: CDH13;
  Gene Name: cadherin 13;
  Uniprot ID:  P55290;
  ENSP ID: ENSP00000394557
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 10317 - protein, 190 aa, Homo sapiens
  Payload ID: 2067;
  Gene Symbol: CDH13;
  Gene Name: cadherin 13;
  Uniprot ID:  P55290;
  ENSP ID: ENSP00000408632
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKRTHNPINSELLLNEGITADLNPCITILAI

SEQ ID NO: 10318 - protein, 52 aa, Homo sapiens
  Payload ID: 2067;
  Gene Symbol: CDH13;
  Gene Name: cadherin 13;
  ENSP ID: ENSP00000442225
MQPRTPLVLCVLLSQVLLLTSAEDLDCTPGFQQKVFHINQPAEFIEDQSILN

SEQ ID NO: 10319 - protein, 701 aa, Homo sapiens
  Payload ID: 2067;
  Gene Symbol: CDH13;
  Gene Name: cadherin 13;
  ENSP ID: ENSP00000454435
FSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 10320 - protein, 67 aa, Homo sapiens
  Payload ID: 2067;
  Gene Symbol: CDH13;
  Gene Name: cadherin 13;
  ENSP ID: ENSP00000455781
MQPRTPLVLCVLLSQTPVRPTIYLCQNLQFIKNKARDSNSLADHKGKRIQVNRLLPGLLFHDELSGI

SEQ ID NO: 10321 - protein, 67 aa, Homo sapiens
  Payload ID: 2067;
  Gene Symbol: CDH13;
  Gene Name: cadherin 13;
  ENSP ID: ENSP00000456297
MQPRTPLVLCVLLSQVLLLTSAEDLDCTPGFQQKVFHINQPAEFIEDQSILNCKQCHSKMLLDSSHI

SEQ ID NO: 10322 - protein, 175 aa, Homo sapiens
  Payload ID: 2067;
  Gene Symbol: CDH13;
  Gene Name: cadherin 13;
  Uniprot ID:  P55290;
  ENSP ID: ENSP00000456491
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKMKIWQVLCLARWLT

SEQ ID NO: 10323 - protein, 37 aa, Homo sapiens
  Payload ID: 2067;
  Gene Symbol: CDH13;
  Gene Name: cadherin 13;
  ENSP ID: ENSP00000457149
MQPRTPLVLCVLLSQSGGPVCKSQFQALPLAVQWLGV

SEQ ID NO: 10324 - protein, 56 aa, Homo sapiens
  Payload ID: 2067;
  Gene Symbol: CDH13;
  Gene Name: cadherin 13;
  ENSP ID: ENSP00000457914
MQPRTPLVLCVLLSQVLLLTSAEDLDCTPGFQQKVFHINQPAEFIEDQSILNYVFY

SEQ ID NO: 10325 - protein, 713 aa, Homo sapiens
  Payload ID: 2067;
  Gene Symbol: CDH13;
  Gene Name: cadherin 13;
  Uniprot ID:  P55290;
  ENSP ID: ENSP00000479395
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 10326 - protein, 353 aa, Homo sapiens
  Payload ID: 2067;
  Gene Symbol: CDH13;
  Gene Name: cadherin 13;
  ENSP ID: ENSP00000482651
PTFCRREFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 10327 - protein, 661 aa, Homo sapiens
  Payload ID: 2067;
  Gene Symbol: CDH13;
  Gene Name: cadherin 13;
  ENSP ID: ENSP00000483719
SQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 10328 - protein, 814 aa, Homo sapiens
  Payload ID: 2068;
  Gene Symbol: CDH15;
  Gene Name: cadherin 15, type 1, M-cadherin (myotubule);
  Uniprot ID:  P55291;
  ENSP ID: ENSP00000289746
MDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEEDQDAYDISQLRHPTALSLPLGPPPLRRDAPQGRLHPQPPRVLPTSPLDIADFINDGLEAADSDPSVPPYDTALIYDYEGDGSVAGTLSSILSSQGDEDQDYDYLRDWGPRFARLADMYGHPCGLEYGARWDHQAREGLSPGALLPRHRGRTA

SEQ ID NO: 10329 - protein, 829 aa, Homo sapiens
  Payload ID: 2069;
  Gene Symbol: CDH16;
  Gene Name: cadherin 16, KSP-cadherin;
  Uniprot ID:  O75309;
  ENSP ID: ENSP00000299752
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 10330 - protein, 807 aa, Homo sapiens
  Payload ID: 2069;
  Gene Symbol: CDH16;
  Gene Name: cadherin 16, KSP-cadherin;
  Uniprot ID:  O75309;
  ENSP ID: ENSP00000377619
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 10331 - protein, 790 aa, Homo sapiens
  Payload ID: 2069;
  Gene Symbol: CDH16;
  Gene Name: cadherin 16, KSP-cadherin;
  Uniprot ID:  O75309;
  ENSP ID: ENSP00000454784
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 10332 - protein, 732 aa, Homo sapiens
  Payload ID: 2069;
  Gene Symbol: CDH16;
  Gene Name: cadherin 16, KSP-cadherin;
  Uniprot ID:  O75309;
  ENSP ID: ENSP00000455263
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 10333 - protein, 175 aa, Homo sapiens
  Payload ID: 2069;
  Gene Symbol: CDH16;
  Gene Name: cadherin 16, KSP-cadherin;
  ENSP ID: ENSP00000455523
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPVCPPTVNQASPSSSLRLQTGMSQAQPTRIFDSTS

SEQ ID NO: 10334 - protein, 749 aa, Homo sapiens
  Payload ID: 2069;
  Gene Symbol: CDH16;
  Gene Name: cadherin 16, KSP-cadherin;
  ENSP ID: ENSP00000456690
MVPAWLWLLCVSVPQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 10335 - protein, 248 aa, Homo sapiens
  Payload ID: 2069;
  Gene Symbol: CDH16;
  Gene Name: cadherin 16, KSP-cadherin;
  ENSP ID: ENSP00000456891
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEGRHRRDFWPGLGARLWAC

SEQ ID NO: 10336 - protein, 238 aa, Homo sapiens
  Payload ID: 2069;
  Gene Symbol: CDH16;
  Gene Name: cadherin 16, KSP-cadherin;
  ENSP ID: ENSP00000460891
IVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQYLLQVRAQNSHGEDYAAPLELHVLVMDENDNV

SEQ ID NO: 10337 - protein, 124 aa, Homo sapiens
  Payload ID: 2069;
  Gene Symbol: CDH16;
  Gene Name: cadherin 16, KSP-cadherin;
  ENSP ID: ENSP00000463451
MDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPK

SEQ ID NO: 10338 - protein, 832 aa, Homo sapiens
  Payload ID: 2070;
  Gene Symbol: CDH17;
  Gene Name: cadherin 17, LI cadherin (liver-intestine);
  Uniprot ID:  Q12864;
  ENSP ID: ENSP00000027335
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 10339 - protein, 580 aa, Homo sapiens
  Payload ID: 2070;
  Gene Symbol: CDH17;
  Gene Name: cadherin 17, LI cadherin (liver-intestine);
  ENSP ID: ENSP00000392811
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPGIILAVVFIRIKKDKGKDNVESAQASEVKPLRS

SEQ ID NO: 10340 - protein, 832 aa, Homo sapiens; identical to SEQ ID NO: 10338
  Payload ID: 2070;
  Gene Symbol: CDH17;
  Gene Name: cadherin 17, LI cadherin (liver-intestine);
  Uniprot ID:  Q12864;
  ENSP ID: ENSP00000401468

SEQ ID NO: 10341 - protein, 147 aa, Homo sapiens
  Payload ID: 2070;
  Gene Symbol: CDH17;
  Gene Name: cadherin 17, LI cadherin (liver-intestine);
  ENSP ID: ENSP00000428189
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLY

SEQ ID NO: 10342 - protein, 90 aa, Homo sapiens
  Payload ID: 2070;
  Gene Symbol: CDH17;
  Gene Name: cadherin 17, LI cadherin (liver-intestine);
  ENSP ID: ENSP00000429730
  MOD_RES (1)..(1): Any amino acid
XIDINDQIPIFEKSDYGNLTLAEDTNIGSTILTIQATDADEPFTGSSKILYHIIKGDSEGRLGVDTDPHTNTGYVIIKKLFTEGRHKRLA

SEQ ID NO: 10343 - protein, 790 aa, Homo sapiens
  Payload ID: 2071;
  Gene Symbol: CDH18;
  Gene Name: cadherin 18, type 2;
  Uniprot ID:  Q13634;
  ENSP ID: ENSP00000274170
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSSAGLSTGALIAILLCVLILLAIVVLFITLRRSKKEPLIISEEDVRENVVTYDDEGGGEEDTEAFDITALRNPSAAEELKYRRDIRPEVKLTPRHQTSSTLESIDVQEFIKQRLAEADLDPSVPPYDSLQTYAYEGQRSEAGSISSLDSATTQSDQDYHYLGDWGPEFKKLAELYGEIESERTT

SEQ ID NO: 10344 - protein, 790 aa, Homo sapiens; identical to SEQ ID NO: 10343
  Payload ID: 2071;
  Gene Symbol: CDH18;
  Gene Name: cadherin 18, type 2;
  Uniprot ID:  Q13634;
  ENSP ID: ENSP00000371710

SEQ ID NO: 10345 - protein, 574 aa, Homo sapiens
  Payload ID: 2071;
  Gene Symbol: CDH18;
  Gene Name: cadherin 18, type 2;
  Uniprot ID:  Q13634;
  ENSP ID: ENSP00000422138
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEAAAPSPSGFVHAREMGVCGPAMQKPSCPRLV

SEQ ID NO: 10346 - protein, 575 aa, Homo sapiens
  Payload ID: 2071;
  Gene Symbol: CDH18;
  Gene Name: cadherin 18, type 2;
  ENSP ID: ENSP00000424931
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEAAAAPSPSGFVHAREMGVCGPAMQKPSCPRLV

SEQ ID NO: 10347 - protein, 790 aa, Homo sapiens; identical to SEQ ID NO: 10343
  Payload ID: 2071;
  Gene Symbol: CDH18;
  Gene Name: cadherin 18, type 2;
  Uniprot ID:  Q13634;
  ENSP ID: ENSP00000425093

SEQ ID NO: 10348 - protein, 590 aa, Homo sapiens
  Payload ID: 2071;
  Gene Symbol: CDH18;
  Gene Name: cadherin 18, type 2;
  ENSP ID: ENSP00000425854
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEGEHIYTYLFIYVVSALTLYVIGFILIYTQTSCKSAFKVSLMLLCYDL

SEQ ID NO: 10349 - protein, 441 aa, Homo sapiens
  Payload ID: 2071;
  Gene Symbol: CDH18;
  Gene Name: cadherin 18, type 2;
  ENSP ID: ENSP00000427383
WVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIAAAAPSPSGFVHAREMGVCGPAMQKPSCPRLV

SEQ ID NO: 10350 - protein, 772 aa, Homo sapiens
  Payload ID: 2072;
  Gene Symbol: CDH19;
  Gene Name: cadherin 19, type 2;
  Uniprot ID:  Q9H159;
  ENSP ID: ENSP00000262150
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 10351 - protein, 434 aa, Homo sapiens
  Payload ID: 2072;
  Gene Symbol: CDH19;
  Gene Name: cadherin 19, type 2;
  ENSP ID: ENSP00000401998
GIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEK

SEQ ID NO: 10352 - protein, 490 aa, Homo sapiens
  Payload ID: 2072;
  Gene Symbol: CDH19;
  Gene Name: cadherin 19, type 2;
  Uniprot ID:  Q9H159;
  ENSP ID: ENSP00000439593
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQGLFF

SEQ ID NO: 10353 - protein, 541 aa, Homo sapiens
  Payload ID: 2072;
  Gene Symbol: CDH19;
  Gene Name: cadherin 19, type 2;
  ENSP ID: ENSP00000463085
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQELVLTFKKNLSSTSPS

SEQ ID NO: 10354 - protein, 65 aa, Homo sapiens
  Payload ID: 2072;
  Gene Symbol: CDH19;
  Gene Name: cadherin 19, type 2;
  ENSP ID: ENSP00000464477
MNCYLLLRFMLGIPLLWPCLGATENSQTKKVKQPVRSHLRVKRGWVWNQFFVPEEMNTTSHHIGQ

SEQ ID NO: 10355 - protein, 906 aa, Homo sapiens
  Payload ID: 2073;
  Gene Symbol: CDH2;
  Gene Name: cadherin 2, type 1, N-cadherin (neuronal);
  Uniprot ID:  P19022;
  ENSP ID: ENSP00000269141
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 10356 - protein, 875 aa, Homo sapiens
  Payload ID: 2073;
  Gene Symbol: CDH2;
  Gene Name: cadherin 2, type 1, N-cadherin (neuronal);
  Uniprot ID:  P19022;
  ENSP ID: ENSP00000382312
MFLLRRYVCIFTEKLKNQAELYVFLSVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 10357 - protein, 191 aa, Homo sapiens
  Payload ID: 2073;
  Gene Symbol: CDH2;
  Gene Name: cadherin 2, type 1, N-cadherin (neuronal);
  ENSP ID: ENSP00000411360
MCNTQRMKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDI

SEQ ID NO: 10358 - protein, 120 aa, Homo sapiens
  Payload ID: 2073;
  Gene Symbol: CDH2;
  Gene Name: cadherin 2, type 1, N-cadherin (neuronal);
  ENSP ID: ENSP00000412120
MVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQP

SEQ ID NO: 10359 - protein, 73 aa, Homo sapiens
  Payload ID: 2073;
  Gene Symbol: CDH2;
  Gene Name: cadherin 2, type 1, N-cadherin (neuronal);
  ENSP ID: ENSP00000414269
MVYAVRSFPLSSEHAKFLIYAQDKETQEKWQVAVKLSLKPTLTEESVKESAEVEEIVFPRQFSKHSGHLQRQK

SEQ ID NO: 10360 - protein, 801 aa, Homo sapiens
  Payload ID: 2074;
  Gene Symbol: CDH20;
  Gene Name: cadherin 20, type 2;
  Uniprot ID:  Q9HBT6;
  ENSP ID: ENSP00000262717
MWTSGRMSNAKNWLGLGMSLYFWGLMDLTTTVLSDTPTPQGELEALLSDKPQSHQRTKRSWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSRGALIAILACIFVLLVLVLLILSMRRHRKQPYIIDDEENIHENIVRYDDEGGGEEDTEAFDIAAMWNPREAQAGAAPKTRQDMLPEIESLSRYVPQTCAVNSTVHSYVLAKLYEADMDLWAPPFDSLQTYMFEGDGSVAGSLSSLQSATSDSEQSFDFLTDWGPRFRKLAELYGASEGPAPLW

SEQ ID NO: 10361 - protein, 801 aa, Homo sapiens; identical to SEQ ID NO: 10360
  Payload ID: 2074;
  Gene Symbol: CDH20;
  Gene Name: cadherin 20, type 2;
  Uniprot ID:  Q9HBT6;
  ENSP ID: ENSP00000442226

SEQ ID NO: 10362 - protein, 801 aa, Homo sapiens; identical to SEQ ID NO: 10360
  Payload ID: 2074;
  Gene Symbol: CDH20;
  Gene Name: cadherin 20, type 2;
  Uniprot ID:  Q9HBT6;
  ENSP ID: ENSP00000444767

SEQ ID NO: 10363 - protein, 828 aa, Homo sapiens
  Payload ID: 2075;
  Gene Symbol: CDH22;
  Gene Name: cadherin 22, type 2;
  Uniprot ID:  Q9UJ99;
  ENSP ID: ENSP00000361336
MRPRPEGRGLRAGVALSPALLLLLLLPPPPTLLGRLWAAGTPSPSAPGARQDGALGAGRVKRGWVWNQFFVVEEYTGTEPLYVGKIHSDSDEGDGAIKYTISGEGAGTIFLIDELTGDIHAMERLDREQKTFYTLRAQARDRATNRLLEPESEFIIKVQDINDSEPRFLHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRFPQKMYQFSIQESAPIGTAVGRVKAEDSDVGENTDMTYHLKDESSSGGDVFKVTTDSDTQEAIIVVQKRLDFESQPVHTVILEALNKFVDPRFADLGTFRDQAIVRVAVTDVDEPPEFRPPSGLLEVQEDAQVGSLVGVVTARDPDAANRPVRYAIDRESDLDQIFDIDADTGAIVTGKGLDRETAGWHNITVLAMEADNHAQLSRASLRIRILDVNDNPPELATPYEAAVCEDAKPGQLIQTISVVDRDEPQGGHRFYFRLVPEAPSNPHFSLLDIQDNTAAVHTQHVGFNRQEQDVFFLPILVVDSGPPTLSSTGTLTIRICGCDSSGTIQSCNTTAFVMAASLSPGALIALLVCVLILVVLVLLILTLRRHHKSHLSSDEDEDMRDNVIKYNDEGGGEQDTEAYDMSALRSLYDFGELKGGDGGGSAGGGAGGGSGGGAGSPPQAHLPSERHSLPQGPPSPEPDFSVFRDFISRKVALADGDLSVPPYDAFQTYAFEGADSPAASLSSLHSGSSGSEQDFAYLSSWGPRFRPLAALYAGHRGDDEAQAS

SEQ ID NO: 10364 - protein, 828 aa, Homo sapiens; identical to SEQ ID NO: 10363
  Payload ID: 2075;
  Gene Symbol: CDH22;
  Gene Name: cadherin 22, type 2;
  Uniprot ID:  Q9UJ99;
  ENSP ID: ENSP00000437790

SEQ ID NO: 10365 - protein, 819 aa, Homo sapiens
  Payload ID: 2076;
  Gene Symbol: CDH24;
  Gene Name: cadherin 24, type 2;
  Uniprot ID:  Q86UP0;
  ENSP ID: ENSP00000267383
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELGWSWGPERGWVPLLVAEWSAPAAPPQRSPVGSAVGIPQDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 10366 - protein, 819 aa, Homo sapiens; identical to SEQ ID NO: 10365
  Payload ID: 2076;
  Gene Symbol: CDH24;
  Gene Name: cadherin 24, type 2;
  Uniprot ID:  Q86UP0;
  ENSP ID: ENSP00000380517

SEQ ID NO: 10367 - protein, 781 aa, Homo sapiens
  Payload ID: 2076;
  Gene Symbol: CDH24;
  Gene Name: cadherin 24, type 2;
  Uniprot ID:  Q86UP0;
  ENSP ID: ENSP00000434821
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 10368 - protein, 781 aa, Homo sapiens; identical to SEQ ID NO: 10367
  Payload ID: 2076;
  Gene Symbol: CDH24;
  Gene Name: cadherin 24, type 2;
  Uniprot ID:  Q86UP0;
  ENSP ID: ENSP00000452493

SEQ ID NO: 10369 - protein, 314 aa, Homo sapiens
  Payload ID: 2076;
  Gene Symbol: CDH24;
  Gene Name: cadherin 24, type 2;
  ENSP ID: ENSP00000478078
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 10370 - protein, 124 aa, Homo sapiens
  Payload ID: 2077;
  Gene Symbol: CDH26;
  Gene Name: cadherin 26;
  Uniprot ID:  Q8IXH8;
  ENSP ID: ENSP00000244049
MKPLIWTWSDVEGQRPALLICTAAAGPTQGVKAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 10371 - protein, 165 aa, Homo sapiens
  Payload ID: 2077;
  Gene Symbol: CDH26;
  Gene Name: cadherin 26;
  Uniprot ID:  Q8IXH8;
  ENSP ID: ENSP00000310845
MKPLIWTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 10372 - protein, 832 aa, Homo sapiens
  Payload ID: 2077;
  Gene Symbol: CDH26;
  Gene Name: cadherin 26;
  Uniprot ID:  Q8IXH8;
  ENSP ID: ENSP00000339390
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 10373 - protein, 444 aa, Homo sapiens
  Payload ID: 2077;
  Gene Symbol: CDH26;
  Gene Name: cadherin 26;
  ENSP ID: ENSP00000360030
  MOD_RES (1)..(1): Any amino acid
XRPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 10374 - protein, 80 aa, Homo sapiens
  Payload ID: 2077;
  Gene Symbol: CDH26;
  Gene Name: cadherin 26;
  ENSP ID: ENSP00000407939
MKPLIWTWSDVEGQRPALLICTAAAGPTQGVKGYGKPFEPRSVKNIHSTPAYPDATMHRQLLAPVEGRMAETLNQKLHVA

SEQ ID NO: 10375 - protein, 829 aa, Homo sapiens
  Payload ID: 2078;
  Gene Symbol: CDH3;
  Gene Name: cadherin 3, type 1, P-cadherin (placental);
  Uniprot ID:  P22223;
  ENSP ID: ENSP00000264012
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 10376 - protein, 784 aa, Homo sapiens
  Payload ID: 2078;
  Gene Symbol: CDH3;
  Gene Name: cadherin 3, type 1, P-cadherin (placental);
  Uniprot ID:  P22223;
  ENSP ID: ENSP00000398485
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIEGRGERGSQRGNGGLQLARGRTRRS

SEQ ID NO: 10377 - protein, 73 aa, Homo sapiens
  Payload ID: 2078;
  Gene Symbol: CDH3;
  Gene Name: cadherin 3, type 1, P-cadherin (placental);
  ENSP ID: ENSP00000462111
  MOD_RES (1)..(1): Any amino acid
XCWLQCAASEPCRAVFREAEVTLEAGGAEQEPGQALGKGKKVTEGKESIEDLPIQTYLTKTQERLGGCSNICP

SEQ ID NO: 10378 - protein, 41 aa, Homo sapiens
  Payload ID: 2078;
  Gene Symbol: CDH3;
  Gene Name: cadherin 3, type 1, P-cadherin (placental);
  ENSP ID: ENSP00000463267
  MOD_RES (1)..(1): Any amino acid
XVRQVLNITDKDLSPHTSPFQAQLTDDSDIYWTAEVNEEGT

SEQ ID NO: 10379 - protein, 155 aa, Homo sapiens
  Payload ID: 2078;
  Gene Symbol: CDH3;
  Gene Name: cadherin 3, type 1, P-cadherin (placental);
  ENSP ID: ENSP00000463364
  MOD_RES (1)..(1): Any amino acid
XGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIEVRRGRPVEGHPLFKPSTSHTGEQAWAWSLGSGFKF

SEQ ID NO: 10380 - protein, 81 aa, Homo sapiens
  Payload ID: 2078;
  Gene Symbol: CDH3;
  Gene Name: cadherin 3, type 1, P-cadherin (placental);
  ENSP ID: ENSP00000463415
VVLRNDVAPTIIPTPMYRPRPANPDEIGNFIIEVLLLCRSPPWQEALATGYSLDPAWPVPPFPPTTPGKTKTQPFHKYMST

SEQ ID NO: 10381 - protein, 48 aa, Homo sapiens
  Payload ID: 2078;
  Gene Symbol: CDH3;
  Gene Name: cadherin 3, type 1, P-cadherin (placental);
  ENSP ID: ENSP00000464021
MGLPRGPLASLLLLQYSWAALGKSQLCLALIMMTSLCGMARQSRKEGH

SEQ ID NO: 10382 - protein, 59 aa, Homo sapiens
  Payload ID: 2078;
  Gene Symbol: CDH3;
  Gene Name: cadherin 3, type 1, P-cadherin (placental);
  ENSP ID: ENSP00000464058
  MOD_RES (1)..(1): Any amino acid
XLNQLKSNKDRDTKIFYSITGPGADSPPEGVFAVEKETGWLLLNKPLDREEIAKYEVLL

SEQ ID NO: 10383 - protein, 842 aa, Homo sapiens
  Payload ID: 2079;
  Gene Symbol: CDH4;
  Gene Name: cadherin 4, type 1, R-cadherin (retinal);
  Uniprot ID:  P55283;
  ENSP ID: ENSP00000443301
MDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 10384 - protein, 822 aa, Homo sapiens
  Payload ID: 2079;
  Gene Symbol: CDH4;
  Gene Name: cadherin 4, type 1, R-cadherin (retinal);
  ENSP ID: ENSP00000480844
MPKSTGMLHGGRENAGVKFSSCVGTKGTQYETNSMDFKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 10385 - protein, 916 aa, Homo sapiens
  Payload ID: 2079;
  Gene Symbol: CDH4;
  Gene Name: cadherin 4, type 1, R-cadherin (retinal);
  Uniprot ID:  P55283;
  ENSP ID: ENSP00000484928
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 10386 - protein, 566 aa, Homo sapiens
  Payload ID: 2079;
  Gene Symbol: CDH4;
  Gene Name: cadherin 4, type 1, R-cadherin (retinal);
  ENSP ID: ENSP00000486568
KVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICERPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 10387 - protein, 566 aa, Homo sapiens; identical to SEQ ID NO: 10386
  Payload ID: 2079;
  Gene Symbol: CDH4;
  Gene Name: cadherin 4, type 1, R-cadherin (retinal);
  ENSP ID: ENSP00000486680

SEQ ID NO: 10388 - protein, 566 aa, Homo sapiens; identical to SEQ ID NO: 10386
  Payload ID: 2079;
  Gene Symbol: CDH4;
  Gene Name: cadherin 4, type 1, R-cadherin (retinal);
  ENSP ID: ENSP00000487355

SEQ ID NO: 10389 - protein, 784 aa, Homo sapiens
  Payload ID: 2080;
  Gene Symbol: CDH5;
  Gene Name: cadherin 5, type 2 (vascular endothelium);
  Uniprot ID:  P33151;
  ENSP ID: ENSP00000344115
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 10390 - protein, 131 aa, Homo sapiens
  Payload ID: 2080;
  Gene Symbol: CDH5;
  Gene Name: cadherin 5, type 2 (vascular endothelium);
  ENSP ID: ENSP00000455302
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENL

SEQ ID NO: 10391 - protein, 17 aa, Homo sapiens
  Payload ID: 2080;
  Gene Symbol: CDH5;
  Gene Name: cadherin 5, type 2 (vascular endothelium);
  ENSP ID: ENSP00000455655
MQRLMMLLATSGACLGL

SEQ ID NO: 10392 - protein, 110 aa, Homo sapiens
  Payload ID: 2080;
  Gene Symbol: CDH5;
  Gene Name: cadherin 5, type 2 (vascular endothelium);
  ENSP ID: ENSP00000456028
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVTQMSPRTG

SEQ ID NO: 10393 - protein, 76 aa, Homo sapiens
  Payload ID: 2080;
  Gene Symbol: CDH5;
  Gene Name: cadherin 5, type 2 (vascular endothelium);
  ENSP ID: ENSP00000456093
MQRLMMLLATSGACLGLLAVAAVAAAGANPAQRDTHSLLPTHRRQKRDWIWNQMHIDEEKNTSLPHHVGKIKSSVS

SEQ ID NO: 10394 - protein, 406 aa, Homo sapiens
  Payload ID: 2080;
  Gene Symbol: CDH5;
  Gene Name: cadherin 5, type 2 (vascular endothelium);
  ENSP ID: ENSP00000458878
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIG

SEQ ID NO: 10395 - protein, 223 aa, Homo sapiens
  Payload ID: 2080;
  Gene Symbol: CDH5;
  Gene Name: cadherin 5, type 2 (vascular endothelium);
  ENSP ID: ENSP00000461880
MPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 10396 - protein, 669 aa, Homo sapiens
  Payload ID: 2080;
  Gene Symbol: CDH5;
  Gene Name: cadherin 5, type 2 (vascular endothelium);
  Uniprot ID:  P33151;
  ENSP ID: ENSP00000479381
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 10397 - protein, 790 aa, Homo sapiens
  Payload ID: 2081;
  Gene Symbol: CDH6;
  Gene Name: cadherin 6, type 2, K-cadherin (fetal kidney);
  Uniprot ID:  P55285;
  ENSP ID: ENSP00000265071
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLVTVVLFAALRRQRKKEPLIISKEDIRDNIVSYNDEGGGEEDTQAFDIGTLRNPEAIEDNKLRRDIVPEALFLPRRTPTARDNTDVRDFINQRLKENDTDPTAPPYDSLATYAYEGTGSVADSLSSLESVTTDADQDYDYLSDWGPRFKKLADMYGGVDSDKDS

SEQ ID NO: 10398 - protein, 608 aa, Homo sapiens
  Payload ID: 2081;
  Gene Symbol: CDH6;
  Gene Name: cadherin 6, type 2, K-cadherin (fetal kidney);
  ENSP ID: ENSP00000424843
MWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLGKLVLPASYLPMVRGSHCYCDTLDLSASPIKAYSLI

SEQ ID NO: 10399 - protein, 785 aa, Homo sapiens
  Payload ID: 2082;
  Gene Symbol: CDH7;
  Gene Name: cadherin 7, type 2;
  Uniprot ID:  Q9ULB5;
  ENSP ID: ENSP00000319166
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLVLILLIVTMRRRKKEPLIFDEERDIRENIVRYDDEGGGEEDTEAFDMAALRNLNVIRDTKTRRDVTPEIQFLSRPAFKSIPDNVIFREFIWERLKEADVDPGAPPYDSLQTYAFEGNGSVAESLSSLDSISSNSDQNYDYLSDWGPRFKRLADMYGTGQESLYS

SEQ ID NO: 10400 - protein, 785 aa, Homo sapiens; identical to SEQ ID NO: 10399
  Payload ID: 2082;
  Gene Symbol: CDH7;
  Gene Name: cadherin 7, type 2;
  Uniprot ID:  Q9ULB5;
  ENSP ID: ENSP00000381058

SEQ ID NO: 10401 - protein, 630 aa, Homo sapiens
  Payload ID: 2082;
  Gene Symbol: CDH7;
  Gene Name: cadherin 7, type 2;
  ENSP ID: ENSP00000443030
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLGRYCFQGLL

SEQ ID NO: 10402 - protein, 745 aa, Homo sapiens
  Payload ID: 2083;
  Gene Symbol: CDH8;
  Gene Name: cadherin 8, type 2;
  ENSP ID: ENSP00000299345
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRLQKRVARRNITRCCLKRKTVENHGFNELRGQDQKRK

SEQ ID NO: 10403 - protein, 744 aa, Homo sapiens
  Payload ID: 2083;
  Gene Symbol: CDH8;
  Gene Name: cadherin 8, type 2;
  ENSP ID: ENSP00000462018
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRWGLPIQWWEERNPIQTCLFSRSRIPRSLLFIFFHKDTKINCITQWTT

SEQ ID NO: 10404 - protein, 799 aa, Homo sapiens
  Payload ID: 2083;
  Gene Symbol: CDH8;
  Gene Name: cadherin 8, type 2;
  Uniprot ID:  P55286;
  ENSP ID: ENSP00000462701
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 10405 - protein, 81 aa, Homo sapiens
  Payload ID: 2083;
  Gene Symbol: CDH8;
  Gene Name: cadherin 8, type 2;
  ENSP ID: ENSP00000462847
MPERLAEMLLDLWTPLIILWITLPPCIYMAPMNQSQVLMSGSPLELNSLGEEQRILNRSKRGWVWNQMFVLEEFSGPEPIL

SEQ ID NO: 10406 - protein, 425 aa, Homo sapiens
  Payload ID: 2083;
  Gene Symbol: CDH8;
  Gene Name: cadherin 8, type 2;
  ENSP ID: ENSP00000462976
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPI

SEQ ID NO: 10407 - protein, 476 aa, Homo sapiens
  Payload ID: 2083;
  Gene Symbol: CDH8;
  Gene Name: cadherin 8, type 2;
  ENSP ID: ENSP00000463266
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEISHSNC

SEQ ID NO: 10408 - protein, 532 aa, Homo sapiens
  Payload ID: 2083;
  Gene Symbol: CDH8;
  Gene Name: cadherin 8, type 2;
  ENSP ID: ENSP00000463511
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVNISMLLMLNMFVYNCLIFD

SEQ ID NO: 10409 - protein, 789 aa, Homo sapiens
  Payload ID: 2084;
  Gene Symbol: CDH9;
  Gene Name: cadherin 9, type 2 (T1-cadherin);
  Uniprot ID:  Q9ULB4;
  ENSP ID: ENSP00000231021
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAIDRKTGRQVEPESEFIIKIHDINDNEPKFTKDLYTASVPEMSGVGTSVIQVTATDADDANYGNSAKVVYSILQGQPYFSVDPESGIIKTALPDMSRENREQYQVVIQAKDMGGQMGGLSGTTTVNITLTDVNNNPPRFPQSTYQFNSPESVPLGTHLGRIKANDPDVGENAEMEYSIAEGDGADMFDVITDKDTQEGIITVKQNLDFENQMLYTLRVDASNTHPDPRFLHLGPFKDTAVVKISVEDIDEPPVFTKVSYLIEVDEDVKEGSIIGQVTAYDPDARNNLIKYSVDRHTDMDRIFGIHSENGSIFTLKALDRESSPWHNITVTATEINNPKQSSHIPVFIRILDINDHAPEFAMYYETFVCENAKPGQLIQTVSVMDKDDPPRGHKFFFEPVPEFTLNPNFTIVDNKDNTAGIMTRKDGYSRNKMSTYLLPILIFDNDYPIQSSTGTLTIRVCACDNQGNMQSCTAEALILSAGLSTGALVAILLCVLILLILVVLFAALKRQRKKEPLIISKDDVRDNIVTYNDEGGGEEDTQAFDIGTLRNPEAREDSKLRRDVMPETIFQIRRTVPLWENIDVQDFIHRRLKENDADPSAPPYDSLATYAYEGNDSIADSLSSLESLTADCNQDYDYLSDWGPRFKKLADMYGGDDSDRD

SEQ ID NO: 10410 - protein, 81 aa, Homo sapiens
  Payload ID: 2084;
  Gene Symbol: CDH9;
  Gene Name: cadherin 9, type 2 (T1-cadherin);
  ENSP ID: ENSP00000422538
MRTYHYIPLFIWTYMFHTVDTILLQEKPNSYLSSKKIAGLTKDDGKMLRRTKRGWMWNQFFLLEEYTGTDTQYVGKLHTDQ

SEQ ID NO: 10411 - protein, 132 aa, Homo sapiens
  Payload ID: 2084;
  Gene Symbol: CDH9;
  Gene Name: cadherin 9, type 2 (T1-cadherin);
  ENSP ID: ENSP00000426239
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAID

SEQ ID NO: 10412 - protein, 3014 aa, Homo sapiens
  Payload ID: 2085;
  Gene Symbol: CELSR1;
  Gene Name: cadherin, EGF LAG seven-pass G-type receptor 1;
  Uniprot ID:  Q9NYQ6;
  ENSP ID: ENSP00000262738
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 10413 - protein, 772 aa, Homo sapiens
  Payload ID: 2085;
  Gene Symbol: CELSR1;
  Gene Name: cadherin, EGF LAG seven-pass G-type receptor 1;
  ENSP ID: ENSP00000414689
  MOD_RES (1)..(1): Any amino acid
XDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTEIS

SEQ ID NO: 10414 - protein, 2923 aa, Homo sapiens
  Payload ID: 2086;
  Gene Symbol: CELSR2;
  Gene Name: cadherin, EGF LAG seven-pass G-type receptor 2;
  Uniprot ID:  Q9HCU4;
  ENSP ID: ENSP00000271332
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 10415 - protein, 3312 aa, Homo sapiens
  Payload ID: 2087;
  Gene Symbol: CELSR3;
  Gene Name: cadherin, EGF LAG seven-pass G-type receptor 3;
  Uniprot ID:  Q9NYQ7;
  ENSP ID: ENSP00000164024
MMARRPPWRGLGGRSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 10416 - protein, 1026 aa, Homo sapiens
  Payload ID: 2088;
  Gene Symbol: CPED1;
  Gene Name: cadherin-like and PC-esterase domain containing 1;
  Uniprot ID:  A4D0V7;
  ENSP ID: ENSP00000309772
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKILFIGDSTNRGIMYYLIERLNETLQEWQKVHGTKFYHNVNGGKTLISYSYYPQFWISPSLRPTFENALEHLLQRSRPLENTGQTVLVVGGVQWLNSNHLQIIHKVLKRENLLNILVIIKTLGIGFHLPVDGVHFLTQSEVQNLWKENLIILDTAKKHGYEVVDTFTITMGRYKEFLQGKCGCHFHEVVKSKLSKEYNFIKMKRSRNHIMGRYFSNQSKLQQGTVTNFRSPYHVRGPINQVCSEILLSRMCANKRTM

SEQ ID NO: 10417 - protein, 202 aa, Homo sapiens
  Payload ID: 2088;
  Gene Symbol: CPED1;
  Gene Name: cadherin-like and PC-esterase domain containing 1;
  ENSP ID: ENSP00000345235
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKQLRRREERQRPGSPASRRLSVR

SEQ ID NO: 10418 - protein, 334 aa, Homo sapiens
  Payload ID: 2088;
  Gene Symbol: CPED1;
  Gene Name: cadherin-like and PC-esterase domain containing 1;
  ENSP ID: ENSP00000391952
MQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQ

SEQ ID NO: 10419 - protein, 549 aa, Homo sapiens
  Payload ID: 2088;
  Gene Symbol: CPED1;
  Gene Name: cadherin-like and PC-esterase domain containing 1;
  ENSP ID: ENSP00000398082
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKK

SEQ ID NO: 10420 - protein, 783 aa, Homo sapiens
  Payload ID: 2088;
  Gene Symbol: CPED1;
  Gene Name: cadherin-like and PC-esterase domain containing 1;
  Uniprot ID:  A4D0V7;
  ENSP ID: ENSP00000406122
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKLGVDVQRVPRSRN

SEQ ID NO: 10421 - protein, 563 aa, Homo sapiens
  Payload ID: 2088;
  Gene Symbol: CPED1;
  Gene Name: cadherin-like and PC-esterase domain containing 1;
  ENSP ID: ENSP00000415573
MQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKLGVDVQRVPRSRN

SEQ ID NO: 10422 - protein, 60 aa, Homo sapiens
  Payload ID: 2088;
  Gene Symbol: CPED1;
  Gene Name: cadherin-like and PC-esterase domain containing 1;
  ENSP ID: ENSP00000428504
RCKKGFSQDKQCFLLSGNAQETRKVEFFGFSGQPLEKLAPGWGSSCRCKGEVDSPFQSVL

SEQ ID NO: 10423 - protein, 3359 aa, Homo sapiens
  Payload ID: 2089;
  Gene Symbol: CDH23;
  Gene Name: cadherin-related 23;
  ENSP ID: ENSP00000224721
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPEVGATGNTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 10424 - protein, 1061 aa, Homo sapiens
  Payload ID: 2089;
  Gene Symbol: CDH23;
  Gene Name: cadherin-related 23;
  ENSP ID: ENSP00000299366
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGAAPASAHLCRPPGALPPPLPDGQPD

SEQ ID NO: 10425 - protein, 1114 aa, Homo sapiens
  Payload ID: 2089;
  Gene Symbol: CDH23;
  Gene Name: cadherin-related 23;
  Uniprot ID:  Q9H251;
  ENSP ID: ENSP00000381768
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 10426 - protein, 1380 aa, Homo sapiens
  Payload ID: 2089;
  Gene Symbol: CDH23;
  Gene Name: cadherin-related 23;
  ENSP ID: ENSP00000381789
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQAATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITVRGWGQGAPFLPI

SEQ ID NO: 10427 - protein, 445 aa, Homo sapiens
  Payload ID: 2089;
  Gene Symbol: CDH23;
  Gene Name: cadherin-related 23;
  ENSP ID: ENSP00000381822
MDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNALAIIITNLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 10428 - protein, 803 aa, Homo sapiens
  Payload ID: 2089;
  Gene Symbol: CDH23;
  Gene Name: cadherin-related 23;
  ENSP ID: ENSP00000388894
  MOD_RES (1)..(1): Any amino acid
XDIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQEDLASPCISPAPPRRAFQSSGEKETSQFPGKELRREPGPSKAQNRAAFTEPLAEAPLLGSKQAQEERAPLPREQAQQLQGSEGEKGGP

SEQ ID NO: 10429 - protein, 530 aa, Homo sapiens
  Payload ID: 2089;
  Gene Symbol: CDH23;
  Gene Name: cadherin-related 23;
  ENSP ID: ENSP00000473454
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 10430 - protein, 954 aa, Homo sapiens
  Payload ID: 2089;
  Gene Symbol: CDH23;
  Gene Name: cadherin-related 23;
  ENSP ID: ENSP00000473539
  MOD_RES (1)..(1): Any amino acid
XDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEENGGWLQGRPEGVGEGLHVQNLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQAAPALASEGSLLDHLQSLPD

SEQ ID NO: 10431 - protein, 1079 aa, Homo sapiens
  Payload ID: 2089;
  Gene Symbol: CDH23;
  Gene Name: cadherin-related 23;
  Uniprot ID:  Q9H251;
  ENSP ID: ENSP00000478374
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKLIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 10432 - protein, 165 aa, Homo sapiens
  Payload ID: 2089;
  Gene Symbol: CDH23;
  Gene Name: cadherin-related 23;
  ENSP ID: ENSP00000480146
  MOD_RES (1)..(1): Any amino acid
XDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLWEKFFCSNSSRFSSAQLVVSSWNQL

SEQ ID NO: 10433 - protein, 1381 aa, Homo sapiens
  Payload ID: 2089;
  Gene Symbol: CDH23;
  Gene Name: cadherin-related 23;
  ENSP ID: ENSP00000482036
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITVRGWGQGAPFLPI

SEQ ID NO: 10434 - protein, 3354 aa, Homo sapiens
  Payload ID: 2089;
  Gene Symbol: CDH23;
  Gene Name: cadherin-related 23;
  ENSP ID: ENSP00000483211
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDETQGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVQVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 10435 - protein, 745 aa, Homo sapiens
  Payload ID: 2090;
  Gene Symbol: CDHR1;
  Gene Name: cadherin-related family member 1;
  Uniprot ID:  Q96JP9;
  ENSP ID: ENSP00000331063
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAEVRRLRYMKNSNFPGTTKSVRKPKFKPKKPHSSQGLFLHPHCEIALFNLSNVNLYSRVFQGAAQAS

SEQ ID NO: 10436 - protein, 598 aa, Homo sapiens
  Payload ID: 2090;
  Gene Symbol: CDHR1;
  Gene Name: cadherin-related family member 1;
  ENSP ID: ENSP00000361189
  MOD_RES (1)..(1): Any amino acid
XITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 10437 - protein, 135 aa, Homo sapiens
  Payload ID: 2090;
  Gene Symbol: CDHR1;
  Gene Name: cadherin-related family member 1;
  ENSP ID: ENSP00000485151
  MOD_RES (1)..(1): Any amino acid
XENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKP

SEQ ID NO: 10438 - protein, 78 aa, Homo sapiens
  Payload ID: 2090;
  Gene Symbol: CDHR1;
  Gene Name: cadherin-related family member 1;
  ENSP ID: ENSP00000485245
  MOD_RES (1)..(1): Any amino acid
XITHAEPANVFDINSHTGEIWLKNSIRSLDALHNITPGRDCLWSLEVQAKDRGSPSFSTTALLKIDITDAEVRRLRSN

SEQ ID NO: 10439 - protein, 48 aa, Homo sapiens
  Payload ID: 2090;
  Gene Symbol: CDHR1;
  Gene Name: cadherin-related family member 1;
  ENSP ID: ENSP00000485460
  MOD_RES (1)..(1): Any amino acid
XMDGDRGKPNRILYSLVNDFPRQCRTILWHDSPAPPCGPVQNFRVHLP

SEQ ID NO: 10440 - protein, 859 aa, Homo sapiens
  Payload ID: 2090;
  Gene Symbol: CDHR1;
  Gene Name: cadherin-related family member 1;
  Uniprot ID:  Q96JP9;
  ENSP ID: ENSP00000485478
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 10441 - protein, 1310 aa, Homo sapiens
  Payload ID: 2091;
  Gene Symbol: CDHR2;
  Gene Name: cadherin-related family member 2;
  Uniprot ID:  Q9BYE9;
  ENSP ID: ENSP00000261944
MAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 10442 - protein, 1310 aa, Homo sapiens; identical to SEQ ID NO: 10441
  Payload ID: 2091;
  Gene Symbol: CDHR2;
  Gene Name: cadherin-related family member 2;
  Uniprot ID:  Q9BYE9;
  ENSP ID: ENSP00000421078

SEQ ID NO: 10443 - protein, 1310 aa, Homo sapiens; identical to SEQ ID NO: 10441
  Payload ID: 2091;
  Gene Symbol: CDHR2;
  Gene Name: cadherin-related family member 2;
  Uniprot ID:  Q9BYE9;
  ENSP ID: ENSP00000424565

SEQ ID NO: 10444 - protein, 62 aa, Homo sapiens
  Payload ID: 2091;
  Gene Symbol: CDHR2;
  Gene Name: cadherin-related family member 2;
  ENSP ID: ENSP00000426838
MAQLWLSCFLLPALVVSVAANVAPKFLANMTSVILPEDLPVVQNGIQECRKLPDETRDTKGY

SEQ ID NO: 10445 - protein, 885 aa, Homo sapiens
  Payload ID: 2092;
  Gene Symbol: CDHR3;
  Gene Name: cadherin-related family member 3;
  Uniprot ID:  Q6ZTQ4;
  ENSP ID: ENSP00000325954
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLTKKGETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 10446 - protein, 149 aa, Homo sapiens
  Payload ID: 2092;
  Gene Symbol: CDHR3;
  Gene Name: cadherin-related family member 3;
  ENSP ID: ENSP00000417198
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEARHECTQSWRN

SEQ ID NO: 10447 - protein, 797 aa, Homo sapiens
  Payload ID: 2092;
  Gene Symbol: CDHR3;
  Gene Name: cadherin-related family member 3;
  ENSP ID: ENSP00000417771
MEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLTKKGETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 10448 - protein, 161 aa, Homo sapiens
  Payload ID: 2092;
  Gene Symbol: CDHR3;
  Gene Name: cadherin-related family member 3;
  ENSP ID: ENSP00000418958
  MOD_RES (1)..(1): Any amino acid
XDYENPSNLAAGNKYTVIIQVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPR

SEQ ID NO: 10449 - protein, 318 aa, Homo sapiens
  Payload ID: 2092;
  Gene Symbol: CDHR3;
  Gene Name: cadherin-related family member 3;
  ENSP ID: ENSP00000419017
YTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPAQGHLSGPEEKRLLSICMVRAVCHHFGLHIASGSPRVPGRPIGQSHPQTLPLQDWEEQGTSDKERRNEDCRERRRGGNYPDEHYL

SEQ ID NO: 10450 - protein, 61 aa, Homo sapiens
  Payload ID: 2092;
  Gene Symbol: CDHR3;
  Gene Name: cadherin-related family member 3;
  ENSP ID: ENSP00000419593
MEQLDFETGPNIFDLQIYVKDEVGVTDLQVLTVQVTDVNEPPQFQGNLAEARHECTQSWRN

SEQ ID NO: 10451 - protein, 199 aa, Homo sapiens
  Payload ID: 2093;
  Gene Symbol: CDHR4;
  Gene Name: cadherin-related family member 4;
  Uniprot ID:  A6H8M9;
  ENSP ID: ENSP00000341302
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPGEARGSRQGGGRHGLSRSSLTSTLASWGNDSGARDSHTWGSAVHSAPPRPRTPRSAGKPRTWDGG

SEQ ID NO: 10452 - protein, 788 aa, Homo sapiens
  Payload ID: 2093;
  Gene Symbol: CDHR4;
  Gene Name: cadherin-related family member 4;
  Uniprot ID:  A6H8M9;
  ENSP ID: ENSP00000391409
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLHFDGRAQDSRTGRDYLFNTHTGARRWL

SEQ ID NO: 10453 - protein, 134 aa, Homo sapiens
  Payload ID: 2093;
  Gene Symbol: CDHR4;
  Gene Name: cadherin-related family member 4;
  ENSP ID: ENSP00000417753
QELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVGPAAASTQQTSPGFAAKQHPGN

SEQ ID NO: 10454 - protein, 151 aa, Homo sapiens
  Payload ID: 2093;
  Gene Symbol: CDHR4;
  Gene Name: cadherin-related family member 4;
  ENSP ID: ENSP00000419433
  MOD_RES (1)..(1): Any amino acid
XSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLQHFDGRAQDSRTGRDYLFNTHTGARRWL

SEQ ID NO: 10455 - protein, 184 aa, Homo sapiens
  Payload ID: 2093;
  Gene Symbol: CDHR4;
  Gene Name: cadherin-related family member 4;
  ENSP ID: ENSP00000420677
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQVSPEHGTVGDRMGVGGWRE

SEQ ID NO: 10456 - protein, 651 aa, Homo sapiens
  Payload ID: 2094;
  Gene Symbol: CDHR5;
  Gene Name: cadherin-related family member 5;
  Uniprot ID:  Q9HBB8;
  ENSP ID: ENSP00000345726
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 10457 - protein, 845 aa, Homo sapiens
  Payload ID: 2094;
  Gene Symbol: CDHR5;
  Gene Name: cadherin-related family member 5;
  Uniprot ID:  Q9HBB8;
  ENSP ID: ENSP00000351118
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 10458 - protein, 845 aa, Homo sapiens; identical to SEQ ID NO: 10457
  Payload ID: 2094;
  Gene Symbol: CDHR5;
  Gene Name: cadherin-related family member 5;
  Uniprot ID:  Q9HBB8;
  ENSP ID: ENSP00000380676

SEQ ID NO: 10459 - protein, 15 aa, Homo sapiens
  Payload ID: 2094;
  Gene Symbol: CDHR5;
  Gene Name: cadherin-related family member 5;
  ENSP ID: ENSP00000431505
MTAGASDYFSLVSVN

SEQ ID NO: 10460 - protein, 190 aa, Homo sapiens
  Payload ID: 2094;
  Gene Symbol: CDHR5;
  Gene Name: cadherin-related family member 5;
  ENSP ID: ENSP00000435082
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLDTKVNSTVIPETQLQAEDRDKDDILFYTLQEMTAGASDYFSLVSVNRPALRLDRPLDFYERPNMTFWLLVRPSVAGHSGGECGTQP

SEQ ID NO: 10461 - protein, 165 aa, Homo sapiens
  Payload ID: 2094;
  Gene Symbol: CDHR5;
  Gene Name: cadherin-related family member 5;
  ENSP ID: ENSP00000436295
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLTKEIRVEEDTKVNSTVIPETQLQAEDRDKDDILFYTLQEMTAGASDYFSLVSVNRPALRLD

SEQ ID NO: 10462 - protein, 106 aa, Homo sapiens
  Payload ID: 2094;
  Gene Symbol: CDHR5;
  Gene Name: cadherin-related family member 5;
  ENSP ID: ENSP00000437255
MGSWALLWPPLLFTGLLVRPPGTMAQAQYCSVNKDIFEVEENTNVTEPLVDIHVPEGQEVTLGALSTPFAFRIQGNQLFLNVTPDYEKAGPFRDEAAWAHTLSTDH

SEQ ID NO: 10463 - protein, 845 aa, Homo sapiens
  Payload ID: 2094;
  Gene Symbol: CDHR5;
  Gene Name: cadherin-related family member 5;
  ENSP ID: ENSP00000480151
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGSPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 10464 - protein, 651 aa, Homo sapiens
  Payload ID: 2094;
  Gene Symbol: CDHR5;
  Gene Name: cadherin-related family member 5;
  ENSP ID: ENSP00000482865
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTGGGPSEDKRFSVVDMAALGGVLGALLLLALLGLAVLVHKHYGPRLKCCSGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 10465 - protein, 15 aa, Homo sapiens
  Payload ID: 2094;
  Gene Symbol: CDHR5;
  Gene Name: cadherin-related family member 5;
  ENSP ID: ENSP00000487773
MTAGASDYFSLVSVN

SEQ ID NO: 10466 - protein, 165 aa, Homo sapiens; identical to SEQ ID NO: 10461
  Payload ID: 2094;
  Gene Symbol: CDHR5;
  Gene Name: cadherin-related family member 5;
  ENSP ID: ENSP00000487868

SEQ ID NO: 10467 - protein, 106 aa, Homo sapiens; identical to SEQ ID NO: 10462
  Payload ID: 2094;
  Gene Symbol: CDHR5;
  Gene Name: cadherin-related family member 5;
  ENSP ID: ENSP00000488183

SEQ ID NO: 10468 - protein, 190 aa, Homo sapiens; identical to SEQ ID NO: 10460
  Payload ID: 2094;
  Gene Symbol: CDHR5;
  Gene Name: cadherin-related family member 5;
  ENSP ID: ENSP00000488189

SEQ ID NO: 10469 - protein, 845 aa, Homo sapiens; identical to SEQ ID NO: 10463
  Payload ID: 2094;
  Gene Symbol: CDHR5;
  Gene Name: cadherin-related family member 5;
  ENSP ID: ENSP00000488376

SEQ ID NO: 10470 - protein, 261 aa, Homo sapiens
  Payload ID: 2095;
  Gene Symbol: CALB1;
  Gene Name: calbindin 1, 28kDa;
  Uniprot ID:  P05937;
  ENSP ID: ENSP00000265431
MAESHLQSSLITASQFFEIWLHFDADGSGYLEGKELQNLIQELQQARKKAGLELSPEMKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 10471 - protein, 119 aa, Homo sapiens
  Payload ID: 2095;
  Gene Symbol: CALB1;
  Gene Name: calbindin 1, 28kDa;
  ENSP ID: ENSP00000429246
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQEN

SEQ ID NO: 10472 - protein, 204 aa, Homo sapiens
  Payload ID: 2095;
  Gene Symbol: CALB1;
  Gene Name: calbindin 1, 28kDa;
  Uniprot ID:  P05937;
  ENSP ID: ENSP00000429602
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 10473 - protein, 3 aa, Homo sapiens
  Payload ID: 2095;
  Gene Symbol: CALB1;
  Gene Name: calbindin 1, 28kDa;
  ENSP ID: ENSP00000430192
MKT

SEQ ID NO: 10474 - protein, 102 aa, Homo sapiens
  Payload ID: 2095;
  Gene Symbol: CALB1;
  Gene Name: calbindin 1, 28kDa;
  ENSP ID: ENSP00000430281
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNND

SEQ ID NO: 10475 - protein, 271 aa, Homo sapiens
  Payload ID: 2096;
  Gene Symbol: CALB2;
  Gene Name: calbindin 2;
  Uniprot ID:  P22676;
  ENSP ID: ENSP00000307508
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 10476 - protein, 192 aa, Homo sapiens
  Payload ID: 2096;
  Gene Symbol: CALB2;
  Gene Name: calbindin 2;
  ENSP ID: ENSP00000340294
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRIEAATLTSMSWMPF

SEQ ID NO: 10477 - protein, 158 aa, Homo sapiens
  Payload ID: 2096;
  Gene Symbol: CALB2;
  Gene Name: calbindin 2;
  ENSP ID: ENSP00000454467
  MOD_RES (1)..(1): Any amino acid
XLENFFQELEKARKGSGMLAQILPTEENFLLCFRQHVGSSAEFMEAWRKYDTDRSGYIEANELKGFLSDLLKKANRPYDEPKLQEYTQTILRMFDLNGDGKLGLSEILLPVQENFLLKFQGMKLTSEEFNAIFTFYDKDRSGYIDEHELDALLKDLYE

SEQ ID NO: 10478 - protein, 235 aa, Homo sapiens
  Payload ID: 2096;
  Gene Symbol: CALB2;
  Gene Name: calbindin 2;
  ENSP ID: ENSP00000454639
  MOD_RES (1)..(1): Any amino acid
XAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKEMNIQQLTNYRKSVMSLAEAGKLYRK

SEQ ID NO: 10479 - protein, 271 aa, Homo sapiens; identical to SEQ ID NO: 10475
  Payload ID: 2096;
  Gene Symbol: CALB2;
  Gene Name: Calbindin 2;
  ENSP ID: ENSP00000488916

SEQ ID NO: 10480 - protein, 192 aa, Homo sapiens; identical to SEQ ID NO: 10476
  Payload ID: 2096;
  Gene Symbol: CALB2;
  Gene Name: Calbindin 2;
  ENSP ID: ENSP00000489007

SEQ ID NO: 10481 - protein, 235 aa, Homo sapiens; identical to SEQ ID NO: 10478
  Payload ID: 2096;
  Gene Symbol: CALB2;
  Gene Name: Calbindin 2;
  ENSP ID: ENSP00000489176
  MOD_RES (1)..(1): Any amino acid

SEQ ID NO: 10482 - protein, 158 aa, Homo sapiens; identical to SEQ ID NO: 10477
  Payload ID: 2096;
  Gene Symbol: CALB2;
  Gene Name: Calbindin 2;
  ENSP ID: ENSP00000489458
  MOD_RES (1)..(1): Any amino acid

SEQ ID NO: 10483 - protein, 2220 aa, Homo sapiens
  Payload ID: 2097;
  Gene Symbol: CABIN1;
  Gene Name: calcineurin binding prt 1;
  Uniprot ID:  Q9Y6J0;
  ENSP ID: ENSP00000263119
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 10484 - protein, 590 aa, Homo sapiens
  Payload ID: 2097;
  Gene Symbol: CABIN1;
  Gene Name: calcineurin binding prt 1;
  ENSP ID: ENSP00000336991
MPRRSRRGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 10485 - protein, 2220 aa, Homo sapiens; identical to SEQ ID NO: 10483
  Payload ID: 2097;
  Gene Symbol: CABIN1;
  Gene Name: calcineurin binding prt 1;
  Uniprot ID:  Q9Y6J0;
  ENSP ID: ENSP00000381364

SEQ ID NO: 10486 - protein, 2141 aa, Homo sapiens
  Payload ID: 2097;
  Gene Symbol: CABIN1;
  Gene Name: calcineurin binding prt 1;
  Uniprot ID:  Q9Y6J0;
  ENSP ID: ENSP00000384694
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 10487 - protein, 357 aa, Homo sapiens
  Payload ID: 2097;
  Gene Symbol: CABIN1;
  Gene Name: calcineurin binding prt 1;
  ENSP ID: ENSP00000394209
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKC

SEQ ID NO: 10488 - protein, 361 aa, Homo sapiens
  Payload ID: 2097;
  Gene Symbol: CABIN1;
  Gene Name: calcineurin binding prt 1;
  ENSP ID: ENSP00000412389
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEE

SEQ ID NO: 10489 - protein, 2170 aa, Homo sapiens
  Payload ID: 2097;
  Gene Symbol: CABIN1;
  Gene Name: calcineurin binding prt 1;
  ENSP ID: ENSP00000480560
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 10490 - protein, 589 aa, Homo sapiens
  Payload ID: 2097;
  Gene Symbol: CABIN1;
  Gene Name: calcineurin binding prt 1;
  ENSP ID: ENSP00000481128
MPRRSRRGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGLPPRDRPRDTPTTPKHPKDSRENFFPVTVVPTAPDPVPADSVQRPSDAHTKPRPALAAATTIITCPPSASASTLDQSKDPGPPRPHRPEATPSMASLGPEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 10491 - protein, 195 aa, Homo sapiens
  Payload ID: 2098;
  Gene Symbol: CHP1;
  Gene Name: calcineurin-like EF-hand prt 1;
  Uniprot ID:  Q99653;
  ENSP ID: ENSP00000335632
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLRMMVGVNISDEQLGSIADRTIQEADQDGDSAISFTEFVKVLEKVDVEQKMSIRFLH

SEQ ID NO: 10492 - protein, 128 aa, Homo sapiens
  Payload ID: 2098;
  Gene Symbol: CHP1;
  Gene Name: calcineurin-like EF-hand prt 1;
  ENSP ID: ENSP00000440490
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHCATHDGRSKYLR

SEQ ID NO: 10493 - protein, 123 aa, Homo sapiens
  Payload ID: 2098;
  Gene Symbol: CHP1;
  Gene Name: calcineurin-like EF-hand prt 1;
  ENSP ID: ENSP00000452772
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHLEEERYI

SEQ ID NO: 10494 - protein, 53 aa, Homo sapiens
  Payload ID: 2098;
  Gene Symbol: CHP1;
  Gene Name: calcineurin-like EF-hand prt 1;
  ENSP ID: ENSP00000453375
MGSRASTLLRDEELEEIKKETGSGKISRGFQNLPSTHWGTGSSMPSFQRERTR

SEQ ID NO: 10495 - protein, 91 aa, Homo sapiens
  Payload ID: 2098;
  Gene Symbol: CHP1;
  Gene Name: calcineurin-like EF-hand prt 1;
  ENSP ID: ENSP00000453392
  MOD_RES (1)..(1): Any amino acid
XREDFQRIPELAINPLGDRIINAFFPEGEDQVNFRGFMRTLAHFRPIEDNEKSKDVNGPEPLNSRSNKLHFAFRLYDLDKDEKISRDELLQ

SEQ ID NO: 10496 - protein, 154 aa, Homo sapiens
  Payload ID: 2098;
  Gene Symbol: CHP1;
  Gene Name: calcineurin-like EF-hand prt 1;
  ENSP ID: ENSP00000454007
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLEKVDVEQKMSIRFLH

SEQ ID NO: 10497 - protein, 196 aa, Homo sapiens
  Payload ID: 2099;
  Gene Symbol: CHP2;
  Gene Name: calcineurin-like EF-hand prt 2;
  Uniprot ID:  O43745;
  ENSP ID: ENSP00000300113
MGSRSSHAAVIPDGDSIRRETGFSQASLLRLHHRFRALDRNKKGYLSRMDLQQIGALAVNPLGDRIIESFFPDGSQRVDFPGFVRVLAHFRPVEDEDTETQDPKKPEPLNSRRNKLHYAFQLYDLDRDGKISRHEMLQVLRLMVGVQVTEEQLENIADRTVQEADEDGDGAVSFVEFTKSLEKMDVEQKMSIRILK

SEQ ID NO: 10498 - protein, 122 aa, Homo sapiens
  Payload ID: 2100;
  Gene Symbol: CPPED1;
  Gene Name: calcineurin-like phosphoesterase domain containing 1;
  Uniprot ID:  Q9BRF8;
  ENSP ID: ENSP00000261660
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPAGQRPPRAPSRGGHRRENCSPILQSR

SEQ ID NO: 10499 - protein, 314 aa, Homo sapiens
  Payload ID: 2100;
  Gene Symbol: CPPED1;
  Gene Name: calcineurin-like phosphoesterase domain containing 1;
  Uniprot ID:  Q9BRF8;
  ENSP ID: ENSP00000371193
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGKPWRTEQTEDLKRVLRAVDRAIPLVLVSGNHDIGNTPTAETVEEFCRTWGDDYFSFWVGGVLFLVLNSQFYENPSKCPSLKQAQDQWLDEQLSIARQRHCQHAIVFQHIPLFLESIDEDDDYYFNLSKSTRKKLADKFIHAGVKVVFSGHYHRNAGGTYQNLDMVVSSAIGCQLGRDPHGLRVVVVTAEKIVHRYYSLDELSEKGIEDDLMDLIKKK

SEQ ID NO: 10500 - protein, 172 aa, Homo sapiens
  Payload ID: 2100;
  Gene Symbol: CPPED1;
  Gene Name: calcineurin-like phosphoesterase domain containing 1;
  Uniprot ID:  Q9BRF8;
  ENSP ID: ENSP00000411127
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGVKVVFSGHYHRNAGGTYQNLDMVVSSAIGCQLGRDPHGLRVVVVTAEKIVHRYYSLDELSEKGIEDDLMDLIKKK

SEQ ID NO: 10501 - protein, 508 aa, Homo sapiens
  Payload ID: 2101;
  Gene Symbol: CALCR;
  Gene Name: calcitonin receptor;
  ENSP ID: ENSP00000352561
MQFSGEKISGQRDLQKSKMRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 10502 - protein, 162 aa, Homo sapiens
  Payload ID: 2101;
  Gene Symbol: CALCR;
  Gene Name: calcitonin receptor;
  ENSP ID: ENSP00000353385
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSCQFSP

SEQ ID NO: 10503 - protein, 474 aa, Homo sapiens
  Payload ID: 2101;
  Gene Symbol: CALCR;
  Gene Name: calcitonin receptor;
  ENSP ID: ENSP00000377959
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 10504 - protein, 474 aa, Homo sapiens; identical to SEQ ID NO: 10503
  Payload ID: 2101;
  Gene Symbol: CALCR;
  Gene Name: calcitonin receptor;
  ENSP ID: ENSP00000389295

SEQ ID NO: 10505 - protein, 290 aa, Homo sapiens
  Payload ID: 2101;
  Gene Symbol: CALCR;
  Gene Name: calcitonin receptor;
  Uniprot ID:  P30988;
  ENSP ID: ENSP00000391369
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWAPAFHRD

SEQ ID NO: 10506 - protein, 490 aa, Homo sapiens
  Payload ID: 2101;
  Gene Symbol: CALCR;
  Gene Name: calcitonin receptor;
  ENSP ID: ENSP00000399552
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRKLTTIFPLNWKYRKALSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 10507 - protein, 274 aa, Homo sapiens
  Payload ID: 2101;
  Gene Symbol: CALCR;
  Gene Name: calcitonin receptor;
  Uniprot ID:  P30988;
  ENSP ID: ENSP00000413179
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWAPAFHRD

SEQ ID NO: 10508 - protein, 461 aa, Homo sapiens [sequence omitted]

SEQ ID NO: 10509 - protein, 37 aa, Homo sapiens
  Payload ID: 2102;
  Gene Symbol: CALCRL;
  Gene Name: calcitonin receptor-like;
  ENSP ID: ENSP00000386599
MEKKCTLYFLVLLPFFMILVTAELEESPEDSIQLGVT

SEQ ID NO: 10510 - protein, 461 aa, Homo sapiens [sequence omitted]

SEQ ID NO: 10511 - protein, 461 aa, Homo sapiens [sequence omitted]

SEQ ID NO: 10512 - protein, 77 aa, Homo sapiens
  Payload ID: 2102;
  Gene Symbol: CALCRL;
  Gene Name: calcitonin receptor-like;
  ENSP ID: ENSP00000415626
MEKKCTLYFLVLLPFFMILVTAELEESPEDSIQLGVTRNKIMTAQYECYQKIMQDPIQQAEGVYCNRTWDGWLCWND

SEQ ID NO: 10513 - protein, 141 aa, Homo sapiens
  Payload ID: 2103;
  Gene Symbol: CALCA;
  Gene Name: calcitonin-related polypeptide alpha;
  Uniprot ID:  P01258;
  ENSP ID: ENSP00000331746
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHVSMPQNAN

SEQ ID NO: 10514 - protein, 128 aa, Homo sapiens
  Payload ID: 2103;
  Gene Symbol: CALCA;
  Gene Name: calcitonin-related polypeptide alpha;
  Uniprot ID:  P06881;
  ENSP ID: ENSP00000354286
MGFQKFSPFLALSILVLLQAGSLHAAPFRSALESSPADPATLSEDEARLLLAALVQDYVQMKASELEQEQEREGSRIIAQKRACDTATCVTHRLAGLLSRSGGVVKNNFVPTNVGSKAFGRRRRDLQA

SEQ ID NO: 10515 - protein, 141 aa, Homo sapiens; identical to SEQ ID NO: 10513
  Payload ID: 2103;
  Gene Symbol: CALCA;
  Gene Name: calcitonin-related polypeptide alpha;
  Uniprot ID:  P01258;
  ENSP ID: ENSP00000379657

SEQ ID NO: 10516 - protein, 128 aa, Homo sapiens; identical to SEQ ID NO: 10514
  Payload ID: 2103;
  Gene Symbol: CALCA;
  Gene Name: calcitonin-related polypeptide alpha;
  Uniprot ID:  P06881;
  ENSP ID: ENSP00000417833

SEQ ID NO: 10517 - protein, 141 aa, Homo sapiens
  Payload ID: 2103;
  Gene Symbol: CALCA;
  Gene Name: calcitonin-related polypeptide alpha;
  Uniprot ID:  P01258;
  ENSP ID: ENSP00000420618
MGFQKFSPFLALSILVLLQAGSLHAAPFRSALESSPADPATLSEDEARLLLAALVQDYVQMKASELEQEQEREGSSLDSPRSKRCGNLSTCMLGTYTQDFNKFHTFPQTAIGVGAPGKKRDMSSDLERDHRPHNHCPEESL

SEQ ID NO: 10518 - protein, 127 aa, Homo sapiens
  Payload ID: 2104;
  Gene Symbol: CALCB;
  Gene Name: calcitonin-related polypeptide beta;
  Uniprot ID:  P10092;
  ENSP ID: ENSP00000346017
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 10519 - protein, 138 aa, Homo sapiens
  Payload ID: 2104;
  Gene Symbol: CALCB;
  Gene Name: calcitonin-related polypeptide beta;
  ENSP ID: ENSP00000428882
MKKEANLQRGGMGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 10520 - protein, 127 aa, Homo sapiens; identical to SEQ ID NO: 10518
  Payload ID: 2104;
  Gene Symbol: CALCB;
  Gene Name: calcitonin-related polypeptide beta;
  Uniprot ID:  P10092;
  ENSP ID: ENSP00000433490

SEQ ID NO: 10521 - protein, 401 aa, Homo sapiens
  Payload ID: 2105;
  Gene Symbol: CANT1;
  Gene Name: calcium activated nucleotidase 1;
  Uniprot ID:  Q8WVQ1;
  ENSP ID: ENSP00000307674
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 10522 - protein, 401 aa, Homo sapiens; identical to SEQ ID NO: 10521
  Payload ID: 2105;
  Gene Symbol: CANT1;
  Gene Name: calcium activated nucleotidase 1;
  Uniprot ID:  Q8WVQ1;
  ENSP ID: ENSP00000376241

SEQ ID NO: 10523 - protein, 38 aa, Homo sapiens
  Payload ID: 2105;
  Gene Symbol: CANT1;
  Gene Name: calcium activated nucleotidase 1;
  ENSP ID: ENSP00000464841
MPVQLSEHPEWNESMHSLRISVGGLPVLASMTKAADPR

SEQ ID NO: 10524 - protein, 76 aa, Homo sapiens
  Payload ID: 2105;
  Gene Symbol: CANT1;
  Gene Name: calcium activated nucleotidase 1;
  ENSP ID: ENSP00000465769
MPVQLSEHPEWNESMHSLRISVGGLPVLASMTKAADPRFRPRWKVILTFFVGAAILWLLCSHRPAPGRPPTHNAHN

SEQ ID NO: 10525 - protein, 118 aa, Homo sapiens
  Payload ID: 2105;
  Gene Symbol: CANT1;
  Gene Name: calcium activated nucleotidase 1;
  ENSP ID: ENSP00000465816
MPVQLSEHPEWNESMHSLRISVGGLPVLASMTKAADPRFRPRWKDTGWDSVSNRSYRRPGHRVKGPRGKHLVQLPEKGLPDPVRQWGQGGRGMGQRPWGPGVPPGGEGERHGAIRPDC

SEQ ID NO: 10526 - protein, 65 aa, Homo sapiens
  Payload ID: 2105;
  Gene Symbol: CANT1;
  Gene Name: calcium activated nucleotidase 1;
  ENSP ID: ENSP00000466637
MPVQLSEHPEWNESMHSLRISVGGLPVLASMTKAADPRFRPRWKVILTFFVGAAILWLLCSHRPA

SEQ ID NO: 10527 - protein, 264 aa, Homo sapiens
  Payload ID: 2105;
  Gene Symbol: CANT1;
  Gene Name: calcium activated nucleotidase 1;
  ENSP ID: ENSP00000466743
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGNWTLSSAGDCKEAVAAGEASLTCRRSWPMDTKIKKMLPFSRNCQKSSCLSRLL

SEQ ID NO: 10528 - protein, 401 aa, Homo sapiens; identical to SEQ ID NO: 10521
  Payload ID: 2105;
  Gene Symbol: CANT1;
  Gene Name: calcium activated nucleotidase 1;
  Uniprot ID:  Q8WVQ1;
  ENSP ID: ENSP00000467437

SEQ ID NO: 10529 - protein, 15 aa, Homo sapiens
  Payload ID: 2105;
  Gene Symbol: CANT1;
  Gene Name: calcium activated nucleotidase 1;
  ENSP ID: ENSP00000467777
MPVQLSEHPEWNESM

SEQ ID NO: 10530 - protein, 38 aa, Homo sapiens; identical to SEQ ID NO: 10523
  Payload ID: 2105;
  Gene Symbol: CANT1;
  Gene Name: calcium activated nucleotidase 1;
  ENSP ID: ENSP00000467886

SEQ ID NO: 10531 - protein, 61 aa, Homo sapiens
  Payload ID: 2105;
  Gene Symbol: CANT1;
  Gene Name: calcium activated nucleotidase 1;
  ENSP ID: ENSP00000467970
MPVQLSEHPEWNESMHSLRISVGGLPVLASMTKAADPRFRPRWKVILTFFVGAAILWLLCS

SEQ ID NO: 10532 - protein, 401 aa, Homo sapiens; identical to SEQ ID NO: 10521
  Payload ID: 2105;
  Gene Symbol: CANT1;
  Gene Name: calcium activated nucleotidase 1;
  Uniprot ID:  Q8WVQ1;
  ENSP ID: ENSP00000477798

SEQ ID NO: 10533 - protein, 191 aa, Homo sapiens
  Payload ID: 2106;
  Gene Symbol: CIB1;
  Gene Name: calcium and integrin binding 1 (calmyrin);
  Uniprot ID:  Q99828;
  ENSP ID: ENSP00000333873
MGGSGSRLSKELLAEYQDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 10534 - protein, 231 aa, Homo sapiens
  Payload ID: 2106;
  Gene Symbol: CIB1;
  Gene Name: calcium and integrin binding 1 (calmyrin);
  Uniprot ID:  Q99828;
  ENSP ID: ENSP00000479860
MGGSGSRLSKELLAEYQDLTFLTKQEILLSVYVVLAPHLVDNEQQARSGNEHTGRPIAENTDSSPLSTRAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 10535 - protein, 187 aa, Homo sapiens
  Payload ID: 2107;
  Gene Symbol: CIB2;
  Gene Name: calcium and integrin binding family member 2;
  Uniprot ID:  O75838;
  ENSP ID: ENSP00000258930
MGNKQTIFTEEQLDNYQDCTFFNKKDILKLHSRFYELAPNLVPMDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 10536 - protein, 144 aa, Homo sapiens
  Payload ID: 2107;
  Gene Symbol: CIB2;
  Gene Name: calcium and integrin binding family member 2;
  Uniprot ID:  O75838;
  ENSP ID: ENSP00000442459
MDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 10537 - protein, 167 aa, Homo sapiens
  Payload ID: 2107;
  Gene Symbol: CIB2;
  Gene Name: calcium and integrin binding family member 2;
  ENSP ID: ENSP00000452752
MDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLRCCHYRGRAWAGQSRAGRDVGAEAPITRYL

SEQ ID NO: 10538 - protein, 147 aa, Homo sapiens
  Payload ID: 2107;
  Gene Symbol: CIB2;
  Gene Name: calcium and integrin binding family member 2;
  ENSP ID: ENSP00000452980
MGNKQTIFTEEQLDNYQDCTFFNKKDILKWGNRGSEGFGHSSRVTQAVHSLAPGPSCLSCTHSDCCVCFLQENPFKERIVAAFSEDGEGNLTFNDFVDMFSVLCESAPRELKANYAFKIYDFNTDNFICKEDLELTLARLTKSELDE

SEQ ID NO: 10539 - protein, 126 aa, Homo sapiens
  Payload ID: 2107;
  Gene Symbol: CIB2;
  Gene Name: calcium and integrin binding family member 2;
  ENSP ID: ENSP00000453256
MGNKQTIFTEEQLDNYQDCTFFNKKDILKLHSRFYELAPNLVPMDYRKSPIVHVPMSLIIQMPELRENPFKERIVAAFSEDGEGNLTFNDFVDMFSVLCESAPRELKANYAFKIYALSTSGSEDTA

SEQ ID NO: 10540 - protein, 54 aa, Homo sapiens
  Payload ID: 2107;
  Gene Symbol: CIB2;
  Gene Name: calcium and integrin binding family member 2;
  ENSP ID: ENSP00000453377
MDYRKSPIVHVPMSLIIQMPELRENPFKERIVAAFSEDGEGNLTFNDFVDMFSV

SEQ ID NO: 10541 - protein, 138 aa, Homo sapiens
  Payload ID: 2107;
  Gene Symbol: CIB2;
  Gene Name: calcium and integrin binding family member 2;
  Uniprot ID:  O75838;
  ENSP ID: ENSP00000453488
MGNKQTIFTEEQLDNYQENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 10542 - protein, 48 aa, Homo sapiens
  Payload ID: 2107;
  Gene Symbol: CIB2;
  Gene Name: calcium and integrin binding family member 2;
  ENSP ID: ENSP00000453654
RFYELAPNLVPMDYRKSPIVHVPMSLIIQMPELRGSCPNANSGSVHVE

SEQ ID NO: 10543 - protein, 92 aa, Homo sapiens
  Payload ID: 2107;
  Gene Symbol: CIB2;
  Gene Name: calcium and integrin binding family member 2;
  ENSP ID: ENSP00000453963
MGNKQTIFTEEQLDNYQDCTFFNKKDILKRIPSKKGSWRRFPRMVRGTSLSTTLWTCFPCSASRLPESSRQTMPSRSMTSTLTTSSARRTWS

SEQ ID NO: 10544 - protein, 187 aa, Homo sapiens
  Payload ID: 2108;
  Gene Symbol: CIB3;
  Gene Name: calcium and integrin binding family member 3;
  Uniprot ID:  Q96Q77;
  ENSP ID: ENSP00000269878
MGNKQTVFTHEQLEAYQDCTFFTRKEIMRLFYRYQDLAPQLVPLDYTTCPDVKVPYELIGSMPELKDNPFRQRIAQVFSEDGDGHMTLDNFLDMFSVMSEMAPRDLKAYYAFKIYDFNNDDYICAWDLEQTVTKLTRGGLSAEEVSLVCEKVLDEADGDHDGRLSLEDFQNMILRAPDFLSTFHIRI

SEQ ID NO: 10545 - protein, 138 aa, Homo sapiens
  Payload ID: 2108;
  Gene Symbol: CIB3;
  Gene Name: calcium and integrin binding family member 3;
  Uniprot ID:  Q96Q77;
  ENSP ID: ENSP00000369188
MGNKQTVFTHEQLEAYQDNPFRQRIAQVFSEDGDGHMTLDNFLDMFSVMSEMAPRDLKAYYAFKIYDFNNDDYICAWDLEQTVTKLTRGGLSAEEVSLVCEKVLDEADGDHDGRLSLEDFQNMILRAPDFLSTFHIRI

SEQ ID NO: 10546 - protein, 45 aa, Homo sapiens
  Payload ID: 2108;
  Gene Symbol: CIB3;
  Gene Name: calcium and integrin binding family member 3;
  ENSP ID: ENSP00000470250
MGNKQTVFTHEQLEAYQDCTFFTRKEIMRTWPHSSCPSTIPPAPM

SEQ ID NO: 10547 - protein, 185 aa, Homo sapiens
  Payload ID: 2109;
  Gene Symbol: CIB4;
  Gene Name: calcium and integrin binding family member 4;
  Uniprot ID:  A0PJX0;
  ENSP ID: ENSP00000288861
MGQCLRYQMHWEDLEEYQALTFLTRNEILCIHDTFLKLCPPGKYYKEATLTMDQVSSLPALRVNPFRDRICRVFSHKGMFSFEDVLGMASVFSEQACPSLKIEYAFRIYDFNENGFIDEEDLQRIILRLLNSDDMSEDLLMDLTNHVLSESDLDNDNMLSFSEFEHAMAKSPDFMNSFRIHFWGC

SEQ ID NO: 10548 - protein, 690 aa, Homo sapiens
  Payload ID: 2110;
  Gene Symbol: CALCOCO1;
  Gene Name: calcium binding and coiled-coil domain 1;
  Uniprot ID:  Q9P1Z2;
  ENSP ID: ENSP00000262059
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 10549 - protein, 606 aa, Homo sapiens
  Payload ID: 2110;
  Gene Symbol: CALCOCO1;
  Gene Name: calcium binding and coiled-coil domain 1;
  Uniprot ID:  Q9P1Z2;
  ENSP ID: ENSP00000397189
MEESPLSRAPSRGGVNFLNVARTYIPNTKVECHYTLPPGTMPSASDWIGIFKVEAACVRDYHTFVWSSVPESTTDGSPIHTSVQFQEPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 10550 - protein, 134 aa, Homo sapiens
  Payload ID: 2110;
  Gene Symbol: CALCOCO1;
  Gene Name: calcium binding and coiled-coil domain 1;
  ENSP ID: ENSP00000446820
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEAD

SEQ ID NO: 10551 - protein, 149 aa, Homo sapiens
  Payload ID: 2110;
  Gene Symbol: CALCOCO1;
  Gene Name: calcium binding and coiled-coil domain 1;
  ENSP ID: ENSP00000447117
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVL

SEQ ID NO: 10552 - protein, 633 aa, Homo sapiens
  Payload ID: 2110;
  Gene Symbol: CALCOCO1;
  Gene Name: calcium binding and coiled-coil domain 1;
  Uniprot ID:  Q9P1Z2;
  ENSP ID: ENSP00000447647
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMAR

SEQ ID NO: 10553 - protein, 120 aa, Homo sapiens
  Payload ID: 2110;
  Gene Symbol: CALCOCO1;
  Gene Name: calcium binding and coiled-coil domain 1;
  ENSP ID: ENSP00000448026
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFRE

SEQ ID NO: 10554 - protein, 159 aa, Homo sapiens
  Payload ID: 2110;
  Gene Symbol: CALCOCO1;
  Gene Name: calcium binding and coiled-coil domain 1;
  ENSP ID: ENSP00000448621
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQE

SEQ ID NO: 10555 - protein, 160 aa, Homo sapiens
  Payload ID: 2110;
  Gene Symbol: CALCOCO1;
  Gene Name: calcium binding and coiled-coil domain 1;
  ENSP ID: ENSP00000449058
MEESPLSRAPSRGGVNFLNVARTYIPNTKVECHYTLPPGTMPSASDWIGIFKVEAACVRDYHTFVWSSVPESTTDGSPIHTSVQFQGTREDGKLGERSQGSGGLKEASYLPKPGAQLYQFRYVNRQGQVCGQSPPFQFREPRPMDELVTLEEADGGSDIL

SEQ ID NO: 10556 - protein, 104 aa, Homo sapiens
  Payload ID: 2110;
  Gene Symbol: CALCOCO1;
  Gene Name: calcium binding and coiled-coil domain 1;
  ENSP ID: ENSP00000449796
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVN

SEQ ID NO: 10557 - protein, 691 aa, Homo sapiens
  Payload ID: 2110;
  Gene Symbol: CALCOCO1;
  Gene Name: calcium binding and coiled-coil domain 1;
  Uniprot ID:  Q9P1Z2;
  ENSP ID: ENSP00000449960
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 10558 - protein, 115 aa, Homo sapiens
  Payload ID: 2110;
  Gene Symbol: CALCOCO1;
  Gene Name: calcium binding and coiled-coil domain 1;
  ENSP ID: ENSP00000450012
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPP

SEQ ID NO: 10559 - protein, 164 aa, Homo sapiens
  Payload ID: 2110;
  Gene Symbol: CALCOCO1;
  Gene Name: calcium binding and coiled-coil domain 1;
  ENSP ID: ENSP00000450083
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLM

SEQ ID NO: 10560 - protein, 232 aa, Homo sapiens
  Payload ID: 2110;
  Gene Symbol: CALCOCO1;
  Gene Name: calcium binding and coiled-coil domain 1;
  ENSP ID: ENSP00000456437
  MOD_RES (1)..(1): Any amino acid
XEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASTIFCRAQIALLPLSPASTPSPTTSGFTVGTLSETSTGGPATPTWKECPICKERFPAESDKDALEDHMDGHFFFSTQDPFTFE

SEQ ID NO: 10561 - protein, 446 aa, Homo sapiens
  Payload ID: 2111;
  Gene Symbol: CALCOCO2;
  Gene Name: calcium binding and coiled-coil domain 2;
  Uniprot ID:  Q13137;
  ENSP ID: ENSP00000258947
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 10562 - protein, 470 aa, Homo sapiens
  Payload ID: 2111;
  Gene Symbol: CALCOCO2;
  Gene Name: calcium binding and coiled-coil domain 2;
  Uniprot ID:  Q13137;
  ENSP ID: ENSP00000398523
MEETIKDPPTSAVLLDHCHFSQVIFNSVEKFYIPGGDVTCHYTFTQHFIPRRKDWIGIFRAFKCFQDKLEQELLKWRSQGQKLQVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 10563 - protein, 404 aa, Homo sapiens
  Payload ID: 2111;
  Gene Symbol: CALCOCO2;
  Gene Name: calcium binding and coiled-coil domain 2;
  Uniprot ID:  Q13137;
  ENSP ID: ENSP00000406974
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 10564 - protein, 154 aa, Homo sapiens
  Payload ID: 2111;
  Gene Symbol: CALCOCO2;
  Gene Name: calcium binding and coiled-coil domain 2;
  ENSP ID: ENSP00000422697
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQFWPTACLSYGEVEEI

SEQ ID NO: 10565 - protein, 374 aa, Homo sapiens
  Payload ID: 2111;
  Gene Symbol: CALCOCO2;
  Gene Name: calcium binding and coiled-coil domain 2;
  Uniprot ID:  Q13137;
  ENSP ID: ENSP00000423437
MWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 10566 - protein, 129 aa, Homo sapiens
  Payload ID: 2111;
  Gene Symbol: CALCOCO2;
  Gene Name: calcium binding and coiled-coil domain 2;
  ENSP ID: ENSP00000424083
  MOD_RES (1)..(1): Any amino acid
XQMKQNETTAMKKQQELMDENFDLSKRLSENEIICNALQRQKERLEGENDVSKKVLPPARSPSRNALSAKQMIFVITPWSNSRCSPFVSIVQFVTRSSQLQRSRSLKTTCSATLSEYPNLLDVYRDFIE

SEQ ID NO: 10567 - protein, 27 aa, Homo sapiens
  Payload ID: 2111;
  Gene Symbol: CALCOCO2;
  Gene Name: calcium binding and coiled-coil domain 2;
  ENSP ID: ENSP00000424169
MWVTLPIDLNNKSAKQQEVQFKAYYLP

SEQ ID NO: 10568 - protein, 467 aa, Homo sapiens
  Payload ID: 2111;
  Gene Symbol: CALCOCO2;
  Gene Name: calcium binding and coiled-coil domain 2;
  Uniprot ID:  Q13137;
  ENSP ID: ENSP00000424352
MEETIKDPPTSAVLLDHCHFSQVIFNSVEKFYIPGGDVTCHYTFTQHFIPRRKDWIGIFRCSLNQTIQLLITPDTGSIWHQVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 10569 - protein, 193 aa, Homo sapiens
  Payload ID: 2111;
  Gene Symbol: CALCOCO2;
  Gene Name: calcium binding and coiled-coil domain 2;
  ENSP ID: ENSP00000424889
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKK

SEQ ID NO: 10570 - protein, 259 aa, Homo sapiens
  Payload ID: 2111;
  Gene Symbol: CALCOCO2;
  Gene Name: calcium binding and coiled-coil domain 2;
  ENSP ID: ENSP00000425090
MWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERL

SEQ ID NO: 10571 - protein, 168 aa, Homo sapiens
  Payload ID: 2111;
  Gene Symbol: CALCOCO2;
  Gene Name: calcium binding and coiled-coil domain 2;
  ENSP ID: ENSP00000425692
MEETIKDPPTSAVLLDHCHFSQVIFNSVEKFYIPGGDVTCHYTFTQHFIPRRKDWIGIFRVGWKTTPYYLPKDDEYYQFCYVDEDGVVRGASIPFQFRPENEEDILVVTTQGEVEEIEQHNKELCKENQELKDSCISLQKQNSDMQAELQKKQEELETLQSINKKLEL

SEQ ID NO: 10572 - protein, 43 aa, Homo sapiens
  Payload ID: 2111;
  Gene Symbol: CALCOCO2;
  Gene Name: calcium binding and coiled-coil domain 2;
  ENSP ID: ENSP00000429963
FDLSKRLSENEIICNALQRQKERLEGENDEQKWWSVPVLDPCF

SEQ ID NO: 10573 - protein, 121 aa, Homo sapiens
  Payload ID: 2111;
  Gene Symbol: CALCOCO2;
  Gene Name: calcium binding and coiled-coil domain 2;
  ENSP ID: ENSP00000461083
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASI

SEQ ID NO: 10574 - protein, 108 aa, Homo sapiens
  Payload ID: 2111;
  Gene Symbol: CALCOCO2;
  Gene Name: calcium binding and coiled-coil domain 2;
  ENSP ID: ENSP00000461184
MEETIKDPPTSAVLLDHCHFSQVIFNSVEKFYIPGGDVTCHYTFTQHFIPRRKDWIGIFRRQSFVLLPRLECNGAISAHRNLRLPGSSDSPASASRVAGITGGVEDNP

SEQ ID NO: 10575 - protein, 167 aa, Homo sapiens
  Payload ID: 2112;
  Gene Symbol: CABP1;
  Gene Name: calcium binding prt 1;
  Uniprot ID:  Q9NZU7;
  ENSP ID: ENSP00000288615
MGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 10576 - protein, 227 aa, Homo sapiens
  Payload ID: 2112;
  Gene Symbol: CABP1;
  Gene Name: calcium binding prt 1;
  Uniprot ID:  Q9NZU7;
  ENSP ID: ENSP00000288616
MGNCVKYPLRNLSRKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 10577 - protein, 370 aa, Homo sapiens
  Payload ID: 2112;
  Gene Symbol: CABP1;
  Gene Name: calcium binding prt 1;
  Uniprot ID:  Q9NZU7;
  ENSP ID: ENSP00000317310
MGGGDGAAFKRPGDGARLQRVLGLGSRREPRSLPAGGPAPRRTAPPPPGHASAGPAAMSSHIAKSESKTSLLKAAAAAASGGSRAPRHGPARDPGLPSRRLPGSCPATPQSSGDPSSRRPLCRPAPREEGARGSQRVLPQAHCRPREALPAAASRPSPSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 10578 - protein, 306 aa, Homo sapiens
  Payload ID: 2112;
  Gene Symbol: CABP1;
  Gene Name: calcium binding prt 1;
  ENSP ID: ENSP00000398959
MCQCVRACVCVCVCACATQRASHSALPGTTISVKDWRLCLLDQFDACARSGLSEPRSLTLRVPSCGKPLPGPGARLGREVTPCLSFAFAWCWLKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 10579 - protein, 220 aa, Homo sapiens
  Payload ID: 2113;
  Gene Symbol: CABP2;
  Gene Name: calcium binding prt 2;
  Uniprot ID:  Q9NPB3;
  ENSP ID: ENSP00000294288
MGNCAKRPWRRGPKDPLQWLGSPPRGSCPSPSSSPKEQGDPAPGVQGYSVLNSLVGPACIFLRPSIAATQLDRELRPEEIEELQVAFQEFDRDRDGYIGCRELGACMRTLGYMPTEMELIEISQQISGGKVDFEDFVELMGPKLLAETADMIGVRELRDAFREFDTNGDGRISVGELRAALKALLGERLSQREVDEILQDVDLNGDGLVDFEEFVRMMSR

SEQ ID NO: 10580 - protein, 163 aa, Homo sapiens
  Payload ID: 2113;
  Gene Symbol: CABP2;
  Gene Name: calcium binding prt 2;
  Uniprot ID:  Q9NPB3;
  ENSP ID: ENSP00000312037
MGNCAKRPWRRGPKDRELRPEEIEELQVAFQEFDRDRDGYIGCRELGACMRTLGYMPTEMELIEISQQISGGKVDFEDFVELMGPKLLAETADMIGVRELRDAFREFDTNGDGRISVGELRAALKALLGERLSQREVDEILQDVDLNGDGLVDFEEFVRMMSR

SEQ ID NO: 10581 - protein, 72 aa, Homo sapiens
  Payload ID: 2113;
  Gene Symbol: CABP2;
  Gene Name: calcium binding prt 2;
  ENSP ID: ENSP00000446180
MGNCAKRPWRRGPKDPLQWLGSPPRGSCPSPSSSPKEQGDPAPGVQGYSVLNSLVGPACIFLRPSIAATQLV

SEQ ID NO: 10582 - protein, 341 aa, Homo sapiens
  Payload ID: 2114;
  Gene Symbol: CAB39;
  Gene Name: calcium binding prt 39;
  Uniprot ID:  Q9Y376;
  ENSP ID: ENSP00000258418
MPFPFGKSHKSPADIVKNLKESMAVLEKQDISDKKAEKATEEVSKNLVAMKEILYGTNEKEPQTEAVAQLAQELYNSGLLSTLVADLQLIDFEGKKDVAQIFNNILRRQIGTRTPTVEYICTQQNILFMLLKGYESPEIALNCGIMLRECIRHEPLAKIILWSEQFYDFFRYVEMSTFDIASDAFATFKDLLTRHKLLSAEFLEQHYDRFFSEYEKLLHSENYVTKRQSLKLLGELLLDRHNFTIMTKYISKPENLKLMMNLLRDKSRNIQFEAFHVFKVFVANPNKTQPILDILLKNQAKLIEFLSKFQNDRTEDEQFNDEKTYLVKQIRDLKRPAQQEA

SEQ ID NO: 10583 - protein, 341 aa, Homo sapiens; identical to SEQ ID NO: 10582
  Payload ID: 2114;
  Gene Symbol: CAB39;
  Gene Name: calcium binding prt 39;
  Uniprot ID:  Q9Y376;
  ENSP ID: ENSP00000386238

SEQ ID NO: 10584 - protein, 341 aa, Homo sapiens; identical to SEQ ID NO: 10582
  Payload ID: 2114;
  Gene Symbol: CAB39;
  Gene Name: calcium binding prt 39;
  Uniprot ID:  Q9Y376;
  ENSP ID: ENSP00000386642

SEQ ID NO: 10585 - protein, 339 aa, Homo sapiens [sequence omitted]

SEQ ID NO: 10586 - protein, 337 aa, Homo sapiens
  Payload ID: 2115;
  Gene Symbol: CAB39L;
  Gene Name: calcium binding prt 39-like;
  Uniprot ID:  Q9H9S4;
  ENSP ID: ENSP00000261669
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 10587 - protein, 337 aa, Homo sapiens; identical to SEQ ID NO: 10586
  Payload ID: 2115;
  Gene Symbol: CAB39L;
  Gene Name: calcium binding prt 39-like;
  Uniprot ID:  Q9H9S4;
  ENSP ID: ENSP00000348113

SEQ ID NO: 10588 - protein, 337 aa, Homo sapiens; identical to SEQ ID NO: 10586
  Payload ID: 2115;
  Gene Symbol: CAB39L;
  Gene Name: calcium binding prt 39-like;
  Uniprot ID:  Q9H9S4;
  ENSP ID: ENSP00000386328

SEQ ID NO: 10589 - protein, 337 aa, Homo sapiens; identical to SEQ ID NO: 10586
  Payload ID: 2115;
  Gene Symbol: CAB39L;
  Gene Name: calcium binding prt 39-like;
  Uniprot ID:  Q9H9S4;
  ENSP ID: ENSP00000386375

SEQ ID NO: 10590 - protein, 93 aa, Homo sapiens
  Payload ID: 2115;
  Gene Symbol: CAB39L;
  Gene Name: calcium binding prt 39-like;
  ENSP ID: ENSP00000386979
MKKMPLFSKSHKNPAEIVKILKDNLAILEKQDKKTDKASEEVSKSLQAMKEILCGTNEKEPPTEAVAQLAQELYSSGLLVTLIADLQLIDFEV

SEQ ID NO: 10591 - protein, 193 aa, Homo sapiens
  Payload ID: 2115;
  Gene Symbol: CAB39L;
  Gene Name: calcium binding prt 39-like;
  ENSP ID: ENSP00000387245
MLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 10592 - protein, 128 aa, Homo sapiens
  Payload ID: 2115;
  Gene Symbol: CAB39L;
  Gene Name: calcium binding prt 39-like;
  ENSP ID: ENSP00000404028
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFM

SEQ ID NO: 10593 - protein, 188 aa, Homo sapiens
  Payload ID: 2115;
  Gene Symbol: CAB39L;
  Gene Name: calcium binding prt 39-like;
  ENSP ID: ENSP00000409253
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFK

SEQ ID NO: 10594 - protein, 280 aa, Homo sapiens
  Payload ID: 2115;
  Gene Symbol: CAB39L;
  Gene Name: calcium binding prt 39-like;
  ENSP ID: ENSP00000416719
ASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 10595 - protein, 337 aa, Homo sapiens; identical to SEQ ID NO: 10586
  Payload ID: 2115;
  Gene Symbol: CAB39L;
  Gene Name: calcium binding prt 39-like;
  Uniprot ID:  Q9H9S4;
  ENSP ID: ENSP00000479669

SEQ ID NO: 10596 - protein, 275 aa, Homo sapiens
  Payload ID: 2116;
  Gene Symbol: CABP4;
  Gene Name: calcium binding prt 4;
  Uniprot ID:  P57796;
  ENSP ID: ENSP00000324960
MTTEQARGQQGPNLAIGRQKPPAGVVTPKSDAEEPPLTRKRSKKERGLRGSRKRTGSSGEQTGPEAPGSSNNPPSTGEGPAGAPPASPGPASSRQSHRHRPDSLHDAAQRTYGPLLNRVFGKDRELGPEELDELQAAFEEFDTDRDGYISHRELGDCMRTLGYMPTEMELLEVSQHIKMRMGGRVDFEEFVELIGPKLREETAHMLGVRELRIAFREFDRDRDGRITVAELREAVPALLGEPLAGPELDEMLREVDLNGDGTVDFDEFVMMLSRH

SEQ ID NO: 10597 - protein, 170 aa, Homo sapiens
  Payload ID: 2116;
  Gene Symbol: CABP4;
  Gene Name: calcium binding prt 4;
  Uniprot ID:  P57796;
  ENSP ID: ENSP00000401555
MTEPWLALGTSWTLPLQDRELGPEELDELQAAFEEFDTDRDGYISHRELGDCMRTLGYMPTEMELLEVSQHIKMRMGGRVDFEEFVELIGPKLREETAHMLGVRELRIAFREFDRDRDGRITVAELREAVPALLGEPLAGPELDEMLREVDLNGDGTVDFDEFVMMLSRH

SEQ ID NO: 10598 - protein, 128 aa, Homo sapiens
  Payload ID: 2116;
  Gene Symbol: CABP4;
  Gene Name: calcium binding prt 4;
  ENSP ID: ENSP00000439145
MTTEQARGQQGPNLAIGRQKPPAGVVTPKSDAEEPPLTRKRSKKERGLRGSRKRTGSSGEQTGPEAPGSSNNPPSTGEGPAGAPPASPGPASSRQSHRHRPDSLHDAAQRTYGPLLNRVFGKGMKEEG

SEQ ID NO: 10599 - protein, 173 aa, Homo sapiens
  Payload ID: 2117;
  Gene Symbol: CABP5;
  Gene Name: calcium binding prt 5;
  Uniprot ID:  Q9NP86;
  ENSP ID: ENSP00000293255
MQFPMGPACIFLRKGIAEKQRERPLGQDEIEELREAFLEFDKDRDGFISCKDLGNLMRTMGYMPTEMELIELGQQIRMNLGGRVDFDDFVELMTPKLLAETAGMIGVQEMRDAFKEFDTNGDGEITLVELQQAMQRLLGERLTPREISEVVREADVNGDGTVDFEEFVKMMSR

SEQ ID NO: 10600 - protein, 215 aa, Homo sapiens
  Payload ID: 2118;
  Gene Symbol: CABP7;
  Gene Name: calcium binding prt 7;
  Uniprot ID:  Q86V35;
  ENSP ID: ENSP00000216144
MPFHPVTAALMYRGIYTVPNLLSEQRPVDIPEDELEEIREAFKVFDRDGNGFISKQELGTAMRSLGYMPNEVELEVIIQRLDMDGDGQVDFEEFVTLLGPKLSTSGIPEKFHGTDFDTVFWKCDMQKLTVDELKRLLYDTFCEHLSMKDIENIIMTEEESHLGTAEECPVDVETCSNQQIRQTCVRKSLICAFAIAFIISVMLIAANQVLRSGMK

SEQ ID NO: 10601 - protein, 281 aa, Homo sapiens
  Payload ID: 2119;
  Gene Symbol: CABYR;
  Gene Name: calcium binding tyr-(Y)-phosphorylation regulated;
  Uniprot ID:  O75952;
  ENSP ID: ENSP00000317095
MEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 10602 - protein, 475 aa, Homo sapiens
  Payload ID: 2119;
  Gene Symbol: CABYR;
  Gene Name: calcium binding tyr-(Y)-phosphorylation regulated;
  Uniprot ID:  O75952;
  ENSP ID: ENSP00000382404
MISSKPRLVVPYGLKTLLEGISRAVLKTNPSNINQFAAAYFQELTMYRVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 10603 - protein, 379 aa, Homo sapiens
  Payload ID: 2119;
  Gene Symbol: CABYR;
  Gene Name: calcium binding tyr-(Y)-phosphorylation regulated;
  Uniprot ID:  O75952;
  ENSP ID: ENSP00000382419
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 10604 - protein, 379 aa, Homo sapiens; identical to SEQ ID NO: 10603
  Payload ID: 2119;
  Gene Symbol: CABYR;
  Gene Name: calcium binding tyr-(Y)-phosphorylation regulated;
  Uniprot ID:  O75952;
  ENSP ID: ENSP00000382421

SEQ ID NO: 10605 - protein, 221 aa, Homo sapiens
  Payload ID: 2119;
  Gene Symbol: CABYR;
  Gene Name: calcium binding tyr-(Y)-phosphorylation regulated;
  Uniprot ID:  O75952;
  ENSP ID: ENSP00000399973
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLEDVAKKSSGSGDKCAPFGSYGIAGEVTVTTAHKRRKAETEN

SEQ ID NO: 10606 - protein, 493 aa, Homo sapiens
  Payload ID: 2119;
  Gene Symbol: CABYR;
  Gene Name: calcium binding tyr-(Y)-phosphorylation regulated;
  Uniprot ID:  O75952;
  ENSP ID: ENSP00000431142
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 10607 - protein, 493 aa, Homo sapiens; identical to SEQ ID NO: 10606
  Payload ID: 2119;
  Gene Symbol: CABYR;
  Gene Name: calcium binding tyr-(Y)-phosphorylation regulated;
  Uniprot ID:  O75952;
  ENSP ID: ENSP00000432870

SEQ ID NO: 10608 - protein, 73 aa, Homo sapiens
  Payload ID: 2119;
  Gene Symbol: CABYR;
  Gene Name: calcium binding tyr-(Y)-phosphorylation regulated;
  ENSP ID: ENSP00000462009
MISSKPRLVVPYGLKTLLEGISRAVLKTNPSNINQFAAAYFQELTMYRGNTTMDIKDLVKQFHQIKDGATNVC

SEQ ID NO: 10609 - protein, 73 aa, Homo sapiens; identical to SEQ ID NO: 10608
  Payload ID: 2119;
  Gene Symbol: CABYR;
  Gene Name: calcium binding tyr-(Y)-phosphorylation regulated;
  ENSP ID: ENSP00000462474

SEQ ID NO: 10610 - protein, 84 aa, Homo sapiens
  Payload ID: 2119;
  Gene Symbol: CABYR;
  Gene Name: calcium binding tyr-(Y)-phosphorylation regulated;
  ENSP ID: ENSP00000462748
MISSKPRLVVPYGLKTLLEGISRAVLKTNPSNINQFAAAYFQELTMYRGNTTMDIKDLVKQFHQIKVEKWSEGTTPQKKLECLK

SEQ ID NO: 10611 - protein, 196 aa, Homo sapiens
  Payload ID: 2119;
  Gene Symbol: CABYR;
  Gene Name: calcium binding tyr-(Y)-phosphorylation regulated;
  ENSP ID: ENSP00000462811
MISSKPRLVVPYGLKTLLEGISRAVLKTNPSNINQFAAAYFQELTMYRVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPP

SEQ ID NO: 10612 - protein, 293 aa, Homo sapiens
  Payload ID: 2119;
  Gene Symbol: CABYR;
  Gene Name: calcium binding tyr-(Y)-phosphorylation regulated;
  ENSP ID: ENSP00000462947
  MOD_RES (1)..(1): Any amino acid
XMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 10613 - protein, 46 aa, Homo sapiens
  Payload ID: 2119;
  Gene Symbol: CABYR;
  Gene Name: calcium binding tyr-(Y)-phosphorylation regulated;
  ENSP ID: ENSP00000463737
MEKSTDTDEDNVTRTEYSDKTTQFPSVYAVPGTEQTEAVGGLSSKP

SEQ ID NO: 10614 - protein, 36 aa, Homo sapiens
  Payload ID: 2119;
  Gene Symbol: CABYR;
  Gene Name: calcium binding tyr-(Y)-phosphorylation regulated;
  ENSP ID: ENSP00000463781
MEKSTDTDEDNVTRTEYSDKTTQFPSVYAVPGTEQT

SEQ ID NO: 10615 - protein, 73 aa, Homo sapiens; identical to SEQ ID NO: 10608
  Payload ID: 2119;
  Gene Symbol: CABYR;
  Gene Name: calcium binding tyr-(Y)-phosphorylation regulated;
  ENSP ID: ENSP00000464595

SEQ ID NO: 10616 - protein, 493 aa, Homo sapiens; identical to SEQ ID NO: 10606
  Payload ID: 2119;
  Gene Symbol: CABYR;
  Gene Name: calcium binding tyr-(Y)-phosphorylation regulated;
  Uniprot ID:  O75952;
  ENSP ID: ENSP00000483621

SEQ ID NO: 10617 - protein, 395 aa, Homo sapiens
  Payload ID: 2119;
  Gene Symbol: CABYR;
  Gene Name: calcium binding tyr-(Y)-phosphorylation regulated;
  ENSP ID: ENSP00000486801
MEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 10618 - protein, 130 aa, Homo sapiens
  Payload ID: 2120;
  Gene Symbol: CACFD1;
  Gene Name: calcium channel flower domain containing 1;
  Uniprot ID:  Q9UGQ2;
  ENSP ID: ENSP00000291722
MSSSGGAPGASASSAPPAQEEGMTWWYRWLCRLSGVLGAVSCAISGLFNCITIHPLNIAAGVWMMMAVVPIVISLTLTTLLGNAIAFATGVLYGLSALGKKGDAISYARIQQQRQQADEEKLAETLEGEL

SEQ ID NO: 10619 - protein, 172 aa, Homo sapiens
  Payload ID: 2120;
  Gene Symbol: CACFD1;
  Gene Name: calcium channel flower domain containing 1;
  Uniprot ID:  Q9UGQ2;
  ENSP ID: ENSP00000317121
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 10620 - protein, 114 aa, Homo sapiens
  Payload ID: 2120;
  Gene Symbol: CACFD1;
  Gene Name: calcium channel flower domain containing 1;
  ENSP ID: ENSP00000414495
MLTAAGSTAELSACAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGK

SEQ ID NO: 10621 - protein, 233 aa, Homo sapiens
  Payload ID: 2120;
  Gene Symbol: CACFD1;
  Gene Name: calcium channel flower domain containing 1;
  Uniprot ID:  Q9UGQ2;
  ENSP ID: ENSP00000440832
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKAQTEAGSFAAQHPREPGPFSEGTRQAFATPAVVSGEIRMPAGAMRSPMPGSSSRGSRRMRRSSRRPWRGSCEGLGAPPSLSPLLALCGSK

SEQ ID NO: 10622 - protein, 191 aa, Homo sapiens
  Payload ID: 2120;
  Gene Symbol: CACFD1;
  Gene Name: calcium channel flower domain containing 1;
  Uniprot ID:  Q9UGQ2;
  ENSP ID: ENSP00000444328
MSSSGGAPGASASSAPPAQEEGMTWWYRWLCRLSGVLGAVSCAISGLFNCITIHPLNIAAGVWMMMAVVPIVISLTLTTLLGNAIAFATGVLYGLSALGKKAQTEAGSFAAQHPREPGPFSEGTRQAFATPAVVSGEIRMPAGAMRSPMPGSSSRGSRRMRRSSRRPWRGSCEGLGAPPSLSPLLALCGSK

SEQ ID NO: 10623 - protein, 233 aa, Homo sapiens; identical to SEQ ID NO: 10621
  Payload ID: 2120;
  Gene Symbol: CACFD1;
  Gene Name: Calcium channel flower domain containing 1;
  ENSP ID: ENSP00000485922

SEQ ID NO: 10624 - protein, 130 aa, Homo sapiens; identical to SEQ ID NO: 10618
  Payload ID: 2120;
  Gene Symbol: CACFD1;
  Gene Name: Calcium channel flower domain containing 1;
  ENSP ID: ENSP00000486098

SEQ ID NO: 10625 - protein, 172 aa, Homo sapiens; identical to SEQ ID NO: 10619
  Payload ID: 2120;
  Gene Symbol: CACFD1;
  Gene Name: Calcium channel flower domain containing 1;
  ENSP ID: ENSP00000486696

SEQ ID NO: 10626 - protein, 191 aa, Homo sapiens; identical to SEQ ID NO: 10622
  Payload ID: 2120;
  Gene Symbol: CACFD1;
  Gene Name: Calcium channel flower domain containing 1;
  ENSP ID: ENSP00000486812

SEQ ID NO: 10627 - protein, 114 aa, Homo sapiens; identical to SEQ ID NO: 10620
  Payload ID: 2120;
  Gene Symbol: CACFD1;
  Gene Name: Calcium channel flower domain containing 1;
  ENSP ID: ENSP00000486907

SEQ ID NO: 10628 - protein, 1103 aa, Homo sapiens
  Payload ID: 2121;
  Gene Symbol: CACNA2D1;
  Gene Name: calcium channel, voltage-dependent, alpha 2/delta subunit 1;
  Uniprot ID:  P54289;
  ENSP ID: ENSP00000348589
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKPIGVGIPTINLRKRRPNIQNPKSQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 10629 - protein, 1091 aa, Homo sapiens
  Payload ID: 2121;
  Gene Symbol: CACNA2D1;
  Gene Name: calcium channel, voltage-dependent, alpha 2/delta subunit 1;
  Uniprot ID:  P54289;
  ENSP ID: ENSP00000349320
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 10630 - protein, 309 aa, Homo sapiens
  Payload ID: 2121;
  Gene Symbol: CACNA2D1;
  Gene Name: calcium channel, voltage-dependent, alpha 2/delta subunit 1;
  ENSP ID: ENSP00000405395
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASDSKEISPSPEEIFNAE

SEQ ID NO: 10631 - protein, 280 aa, Homo sapiens
  Payload ID: 2121;
  Gene Symbol: CACNA2D1;
  Gene Name: calcium channel, voltage-dependent, alpha 2/delta subunit 1;
  ENSP ID: ENSP00000409374
  MOD_RES (1)..(1): Any amino acid
XKRLTPRFTLCPNGYYFAIDPNGYVLLHPNLQPKPIGVGIPTINLRKRRPNIQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFN

SEQ ID NO: 10632 - protein, 1145 aa, Homo sapiens
  Payload ID: 2122;
  Gene Symbol: CACNA2D2;
  Gene Name: calcium channel, voltage-dependent, alpha 2/delta subunit 2;
  Uniprot ID:  Q9NY47;
  ENSP ID: ENSP00000266039
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 10633 - protein, 1076 aa, Homo sapiens
  Payload ID: 2122;
  Gene Symbol: CACNA2D2;
  Gene Name: calcium channel, voltage-dependent, alpha 2/delta subunit 2;
  Uniprot ID:  Q9NY47;
  ENSP ID: ENSP00000354228
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 10634 - protein, 1143 aa, Homo sapiens
  Payload ID: 2122;
  Gene Symbol: CACNA2D2;
  Gene Name: calcium channel, voltage-dependent, alpha 2/delta subunit 2;
  Uniprot ID:  Q9NY47;
  ENSP ID: ENSP00000390329
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 10635 - protein, 1144 aa, Homo sapiens
  Payload ID: 2122;
  Gene Symbol: CACNA2D2;
  Gene Name: calcium channel, voltage-dependent, alpha 2/delta subunit 2;
  ENSP ID: ENSP00000404631
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKQCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 10636 - protein, 1153 aa, Homo sapiens
  Payload ID: 2122;
  Gene Symbol: CACNA2D2;
  Gene Name: calcium channel, voltage-dependent, alpha 2/delta subunit 2;
  ENSP ID: ENSP00000407393
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKQCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 10637 - protein, 1150 aa, Homo sapiens
  Payload ID: 2122;
  Gene Symbol: CACNA2D2;
  Gene Name: calcium channel, voltage-dependent, alpha 2/delta subunit 2;
  Uniprot ID:  Q9NY47;
  ENSP ID: ENSP00000418081
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 10638 - protein, 1091 aa, Homo sapiens
  Payload ID: 2123;
  Gene Symbol: CACNA2D3;
  Gene Name: calcium channel, voltage-dependent, alpha 2/delta subunit 3;
  Uniprot ID:  Q8IZS8;
  ENSP ID: ENSP00000288197
MAGPGSPRRASRGASALLAAALLYAALGDVVRSEQQIPLSVVKLWASAFGGEIKSIAAKYSGSQLLQKKYKEYEKDVAIEEIDGLQLVKKLAKNMEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 10639 - protein, 1091 aa, Homo sapiens; identical to SEQ ID NO: 10638
  Payload ID: 2123;
  Gene Symbol: CACNA2D3;
  Gene Name: calcium channel, voltage-dependent, alpha 2/delta subunit 3;
  Uniprot ID:  Q8IZS8;
  ENSP ID: ENSP00000389506

SEQ ID NO: 10640 - protein, 997 aa, Homo sapiens
  Payload ID: 2123;
  Gene Symbol: CACNA2D3;
  Gene Name: calcium channel, voltage-dependent, alpha 2/delta subunit 3;
  Uniprot ID:  Q8IZS8;
  ENSP ID: ENSP00000417279
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 10641 - protein, 525 aa, Homo sapiens
  Payload ID: 2123;
  Gene Symbol: CACNA2D3;
  Gene Name: calcium channel, voltage-dependent, alpha 2/delta subunit 3;
  ENSP ID: ENSP00000417318
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHRRRPA

SEQ ID NO: 10642 - protein, 46 aa, Homo sapiens
  Payload ID: 2123;
  Gene Symbol: CACNA2D3;
  Gene Name: calcium channel, voltage-dependent, alpha 2/delta subunit 3;
  ENSP ID: ENSP00000417455
MEEMFHKKSEAVRRLVEAAEEAHLKHEFDADLQTLQLSMGFIGLNL

SEQ ID NO: 10643 - protein, 126 aa, Homo sapiens
  Payload ID: 2123;
  Gene Symbol: CACNA2D3;
  Gene Name: calcium channel, voltage-dependent, alpha 2/delta subunit 3;
  ENSP ID: ENSP00000418028
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGF

SEQ ID NO: 10644 - protein, 519 aa, Homo sapiens
  Payload ID: 2123;
  Gene Symbol: CACNA2D3;
  Gene Name: calcium channel, voltage-dependent, alpha 2/delta subunit 3;
  Uniprot ID:  Q8IZS8;
  ENSP ID: ENSP00000418228
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHRRRPA

SEQ ID NO: 10645 - protein, 1091 aa, Homo sapiens; identical to SEQ ID NO: 10638
  Payload ID: 2123;
  Gene Symbol: CACNA2D3;
  Gene Name: calcium channel, voltage-dependent, alpha 2/delta subunit 3;
  Uniprot ID:  Q8IZS8;
  ENSP ID: ENSP00000419101

SEQ ID NO: 10646 - protein, 519 aa, Homo sapiens; identical to SEQ ID NO: 10644
  Payload ID: 2123;
  Gene Symbol: CACNA2D3;
  Gene Name: calcium channel, voltage-dependent, alpha 2/delta subunit 3;
  Uniprot ID:  Q8IZS8;
  ENSP ID: ENSP00000478969

SEQ ID NO: 10647 - protein, 1137 aa, Homo sapiens
  Payload ID: 2124;
  Gene Symbol: CACNA2D4;
  Gene Name: calcium channel, voltage-dependent, alpha 2/delta subunit 4;
  Uniprot ID:  Q7Z3S7;
  ENSP ID: ENSP00000372169
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 10648 - protein, 601 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000403371
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKMPSTNSRPNAPPPWTLAAWSARIRLSEHQQWLHPLPSRPPAPVQRGEETKTQT

SEQ ID NO: 10649 - protein, 192 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000440231
  MOD_RES (1)..(1): Any amino acid
XELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRESDYV

SEQ ID NO: 10650 - protein, 41 aa, Homo sapiens
  Payload ID: 2124;
  Gene Symbol: CACNA2D4;
  Gene Name: calcium channel, voltage-dependent, alpha 2/delta subunit 4;
  Uniprot ID:  Q7Z3S7;
  ENSP ID: ENSP00000442329
MKLEFLQRKFWAATRQDLDCFVIDNNGFILISKRSRESDYV

SEQ ID NO: 10651 - protein, 282 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000443038
MKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 10652 - protein, 267 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000446341
MKLEFLQRKFWAATRQDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 10653 - protein, 56 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000464949
MKLEFLQRKFWAATRQCSTVDGPCTQSCEDSDLDCFVIDNNGFILISKRSRESDYV

SEQ ID NO: 10654 - protein, 1154 aa, Homo sapiens
  Payload ID: 2124;
  Gene Symbol: CACNA2D4;
  Gene Name: calcium channel, voltage-dependent, alpha 2/delta subunit 4;
  Uniprot ID:  Q7Z3S7;
  ENSP ID: ENSP00000465060
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEVRVEADRGWAGFSSPNPLCLGLCPCRQEHIGMPMNTPVPVLLGGNIRVYAL

SEQ ID NO: 10655 - protein, 1112 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000465372
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 10656 - protein, 56 aa, Homo sapiens; identical to SEQ ID NO: 10653
  Payload ID: 2124;
  Gene Symbol: CACNA2D4;
  Gene Name: calcium channel, voltage-dependent, alpha 2/delta subunit 4;
  ENSP ID: ENSP00000467333

SEQ ID NO: 10657 - protein, 1090 aa, Homo sapiens
  Payload ID: 2124;
  Gene Symbol: CACNA2D4;
  Gene Name: calcium channel, voltage-dependent, alpha 2/delta subunit 4;
  Uniprot ID:  Q7Z3S7;
  ENSP ID: ENSP00000467697
MAVALGTRRRDRVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEVRVEADRGWAGFSSPNPLCLGLCPCRQEHIGMPMNTPVPVLLGGNIRVYAL

SEQ ID NO: 10658 - protein, 780 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000468080
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGILVQADRDNREHFKLLVEELMVKGVGVVDQALREAFQILKQFQEAKQGSLCNQAIMLISDGAVEDYEPVFEKYNWPDCKISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSREPGIKLRKKPIQT

SEQ ID NO: 10659 - protein, 284 aa, Homo sapiens
  Payload ID: 2124;
  Gene Symbol: CACNA2D4;
  Gene Name: calcium channel, voltage-dependent, alpha 2/delta subunit 4;
  ENSP ID: ENSP00000468167
  MOD_RES (1)..(1): Any amino acid
XGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 10660 - protein, 1073 aa, Homo sapiens
  Payload ID: 2124;
  Gene Symbol: CACNA2D4;
  Gene Name: calcium channel, voltage-dependent, alpha 2/delta subunit 4;
  Uniprot ID:  Q7Z3S7;
  ENSP ID: ENSP00000468530
MAVALGTRRRDRVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 10661 - protein, 523 aa, Homo sapiens
  Payload ID: 2125;
  Gene Symbol: CACNB1;
  Gene Name: calcium channel, voltage-dependent, beta 1 subunit;
  Uniprot ID:  Q02641;
  ENSP ID: ENSP00000345461
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGNEMTNLAFELDPLELEEEEAELGEQSGSAKTSVSSVTTPPPHGKRIPFFKKTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 10662 - protein, 598 aa, Homo sapiens
  Payload ID: 2125;
  Gene Symbol: CACNB1;
  Gene Name: calcium channel, voltage-dependent, beta 1 subunit;
  Uniprot ID:  Q02641;
  ENSP ID: ENSP00000377840
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 10663 - protein, 478 aa, Homo sapiens
  Payload ID: 2125;
  Gene Symbol: CACNB1;
  Gene Name: calcium channel, voltage-dependent, beta 1 subunit;
  Uniprot ID:  Q02641;
  ENSP ID: ENSP00000377847
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 10664 - protein, 216 aa, Homo sapiens
  Payload ID: 2125;
  Gene Symbol: CACNB1;
  Gene Name: calcium channel, voltage-dependent, beta 1 subunit;
  ENSP ID: ENSP00000477612
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASDRACAPL

SEQ ID NO: 10665 - protein, 632 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000282343
MNQGSGLDLLKISYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10666 - protein, 660 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000320025
MVQRDMSKSPPTAAAAVAQEIQMELLENVAPAGALGAAAQSYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10667 - protein, 636 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000344474
MVQRDMSKSPPTAAAAVAQEIQMELLENVAPAGALGAAAQSYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSGAKSADEQDQWKTAGLFWRFTTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10668 - protein, 612 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000366532
MKATWIRLLKRAKGGRLKNSDICGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10669 - protein, 567 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000366536
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAKQKQKSTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10670 - protein, 410 aa, Homo sapiens
  Payload ID: 2126;
  Gene Symbol: CACNB2;
  Gene Name: calcium channel, voltage-dependent, beta 2 subunit;
  ENSP ID: ENSP00000366545
MVQRDMSKSPPTAAAAVAQEIQMELLENVAPAGALGAAAQSYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10671 - protein, 606 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000366546
MLDRRLIAPQTKYIIPGGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10672 - protein, 608 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000366548
MNQGSGLDLLKISYGKGARRKNRFKGSDGSTSSDTTSNSFVRQGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSGAKSADEQDQWKTAGLFWRFTTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10673 - protein, 605 aa, Homo sapiens
  Payload ID: 2126;
  Gene Symbol: CACNB2;
  Gene Name: calcium channel, voltage-dependent, beta 2 subunit;
  Uniprot ID:  Q08289;
  ENSP ID: ENSP00000379821
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10674 - protein, 164 aa, Homo sapiens
  Payload ID: 2126;
  Gene Symbol: CACNB2;
  Gene Name: calcium channel, voltage-dependent, beta 2 subunit;
  ENSP ID: ENSP00000478676
MYLWRRTGRQCAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10675 - protein, 581 aa, Homo sapiens
  Payload ID: 2126;
  Gene Symbol: CACNB2;
  Gene Name: calcium channel, voltage-dependent, beta 2 subunit;
  ENSP ID: ENSP00000479756
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSGAKSADEQDQWKTAGLFWRFTTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10676 - protein, 355 aa, Homo sapiens
  Payload ID: 2126;
  Gene Symbol: CACNB2;
  Gene Name: calcium channel, voltage-dependent, beta 2 subunit;
  ENSP ID: ENSP00000480260
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 10677 - protein, 176 aa, Homo sapiens
  Payload ID: 2126;
  Gene Symbol: CACNB2;
  Gene Name: calcium channel, voltage-dependent, beta 2 subunit;
  ENSP ID: ENSP00000480563
MLDRRLIAPQTKYIIPGGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSDRAHSSV

SEQ ID NO: 10678 - protein, 484 aa, Homo sapiens
  Payload ID: 2127;
  Gene Symbol: CACNB3;
  Gene Name: calcium channel, voltage-dependent, beta 3 subunit;
  Uniprot ID:  P54284;
  ENSP ID: ENSP00000301050
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 10679 - protein, 483 aa, Homo sapiens
  Payload ID: 2127;
  Gene Symbol: CACNB3;
  Gene Name: calcium channel, voltage-dependent, beta 3 subunit;
  Uniprot ID:  P54284;
  ENSP ID: ENSP00000444160
MSFSDSSATFLLNEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 10680 - protein, 471 aa, Homo sapiens
  Payload ID: 2127;
  Gene Symbol: CACNB3;
  Gene Name: calcium channel, voltage-dependent, beta 3 subunit;
  Uniprot ID:  P54284;
  ENSP ID: ENSP00000445495
MEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 10681 - protein, 457 aa, Homo sapiens
  Payload ID: 2127;
  Gene Symbol: CACNB3;
  Gene Name: calcium channel, voltage-dependent, beta 3 subunit;
  ENSP ID: ENSP00000446529
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 10682 - protein, 105 aa, Homo sapiens
  Payload ID: 2127;
  Gene Symbol: CACNB3;
  Gene Name: calcium channel, voltage-dependent, beta 3 subunit;
  ENSP ID: ENSP00000446611
MSFSDSSATFLLNEGSADSYTSRPSLDSDVSLEEDRESARREVESQAQQQLERAKHKPVAFAVRTNVSYCGVLDEECPVQGSGVNFEAKDFLHIKEEIWEPFQPE

SEQ ID NO: 10683 - protein, 84 aa, Homo sapiens
  Payload ID: 2127;
  Gene Symbol: CACNB3;
  Gene Name: calcium channel, voltage-dependent, beta 3 subunit;
  ENSP ID: ENSP00000447261
QQLERAKHKPVAFAVRTNVSYCGVLDEECPVQGSGVNFEAKDFLHIKENLGGPPCLSHSFALHPVISVLVPHTSLENRAPDFVP

SEQ ID NO: 10684 - protein, 37 aa, Homo sapiens
  Payload ID: 2127;
  Gene Symbol: CACNB3;
  Gene Name: calcium channel, voltage-dependent, beta 3 subunit;
  ENSP ID: ENSP00000447462
MYDDSYVPGFEDSEAPPAEASSAAGILSSCPAWRAWR

SEQ ID NO: 10685 - protein, 55 aa, Homo sapiens
  Payload ID: 2127;
  Gene Symbol: CACNB3;
  Gene Name: calcium channel, voltage-dependent, beta 3 subunit;
  ENSP ID: ENSP00000448074
MRPVVLVGPSLKGYEVTDMMQKALFDFLKHRFDGRISITRVTADLSLAKRSVLNN

SEQ ID NO: 10686 - protein, 76 aa, Homo sapiens
  Payload ID: 2127;
  Gene Symbol: CACNB3;
  Gene Name: calcium channel, voltage-dependent, beta 3 subunit;
  ENSP ID: ENSP00000448076
  MOD_RES (1)..(1): Any amino acid
XKDFLHIKEKYSNDWWIGRLVKEGGDIAFIPSPQRLESIRLKQEQKARRSGNPSSLSDIGNRRSPPPSLGGTCSPI

SEQ ID NO: 10687 - protein, 122 aa, Homo sapiens
  Payload ID: 2127;
  Gene Symbol: CACNB3;
  Gene Name: calcium channel, voltage-dependent, beta 3 subunit;
  ENSP ID: ENSP00000448137
MRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPK

SEQ ID NO: 10688 - protein, 443 aa, Homo sapiens
  Payload ID: 2127;
  Gene Symbol: CACNB3;
  Gene Name: calcium channel, voltage-dependent, beta 3 subunit;
  Uniprot ID:  P54284;
  ENSP ID: ENSP00000448304
MYDDSYVPGFEDSEAGSADSYTSRPSLDSDVSLEEDRESARREVESQAQQQLERAKKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 10689 - protein, 151 aa, Homo sapiens
  Payload ID: 2127;
  Gene Symbol: CACNB3;
  Gene Name: calcium channel, voltage-dependent, beta 3 subunit;
  ENSP ID: ENSP00000449389
MEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLGGTCSPI

SEQ ID NO: 10690 - protein, 144 aa, Homo sapiens
  Payload ID: 2127;
  Gene Symbol: CACNB3;
  Gene Name: calcium channel, voltage-dependent, beta 3 subunit;
  ENSP ID: ENSP00000449497
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEYSNDWWIGRLVKEGGDIAFIPSPQRLESIRLKQEQKARRSGNPSSLS

SEQ ID NO: 10691 - protein, 458 aa, Homo sapiens
  Payload ID: 2128;
  Gene Symbol: CACNB4;
  Gene Name: calcium channel, voltage-dependent, beta 4 subunit;
  Uniprot ID:  O00305;
  ENSP ID: ENSP00000201943
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 10692 - protein, 207 aa, Homo sapiens
  Payload ID: 2128;
  Gene Symbol: CACNB4;
  Gene Name: calcium channel, voltage-dependent, beta 4 subunit;
  ENSP ID: ENSP00000353425
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEDFNNESDS

SEQ ID NO: 10693 - protein, 473 aa, Homo sapiens
  Payload ID: 2128;
  Gene Symbol: CACNB4;
  Gene Name: calcium channel, voltage-dependent, beta 4 subunit;
  ENSP ID: ENSP00000380490
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 10694 - protein, 515 aa, Homo sapiens
  Payload ID: 2128;
  Gene Symbol: CACNB4;
  Gene Name: calcium channel, voltage-dependent, beta 4 subunit;
  ENSP ID: ENSP00000390161
AAVLTGFSLAPVCRVQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 10695 - protein, 108 aa, Homo sapiens
  Payload ID: 2128;
  Gene Symbol: CACNB4;
  Gene Name: calcium channel, voltage-dependent, beta 4 subunit;
  ENSP ID: ENSP00000399242
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPL

SEQ ID NO: 10696 - protein, 502 aa, Homo sapiens
  Payload ID: 2128;
  Gene Symbol: CACNB4;
  Gene Name: calcium channel, voltage-dependent, beta 4 subunit;
  Uniprot ID:  O00305;
  ENSP ID: ENSP00000410978
MDVVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 10697 - protein, 520 aa, Homo sapiens
  Payload ID: 2128;
  Gene Symbol: CACNB4;
  Gene Name: calcium channel, voltage-dependent, beta 4 subunit;
  Uniprot ID:  O00305;
  ENSP ID: ENSP00000438949
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 10698 - protein, 486 aa, Homo sapiens
  Payload ID: 2128;
  Gene Symbol: CACNB4;
  Gene Name: calcium channel, voltage-dependent, beta 4 subunit;
  Uniprot ID:  O00305;
  ENSP ID: ENSP00000443893
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 10699 - protein, 114 aa, Homo sapiens
  Payload ID: 2129;
  Gene Symbol: CBARP;
  Gene Name: calcium channel, voltage-dependent, beta subunit associated regulatory prt;
  ENSP ID: ENSP00000215376
MQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQGVGGPRRVLSE

SEQ ID NO: 10700 - protein, 725 aa, Homo sapiens
  Payload ID: 2129;
  Gene Symbol: CBARP;
  Gene Name: calcium channel, voltage-dependent, beta subunit associated regulatory prt;
  Uniprot ID:  Q8N350;
  ENSP ID: ENSP00000371917
MATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRQGGWQSTAAGASGMGGGRALMARCCRRYTLTEGDFHHLKNARLTHLHLPPLKIVTIHECDSGEASSATTPHPATSPKATLAIFQPPGKALTGRSVGPSSALPGDPYNSAAGATDFAEISPSASSDSGEGTSLDAGTRSTKAGGPGAAAGPGEAGPGSGAGTVLQFLTRLRRHASLDGASPYFKVKKWKLEPSQRAASLDTRGSPKRHHFQRQRAASESTEQEEGDAPQEDFIQYIARAGDAVAFPHPRPFLASPPPALGRLEAAEAAGGASPDSPPERGAGSAGPEQQQPPLEPDAERDAGPEQAQTSYRDLWSLRASLELHAAASDHSSSGNDRDSVRSGDSSGSGSGGAAPAFPPPSPPAPRPKDGEARRLLQMDSGYASIEGRGAGDDTEPPAAPARPRSPRAWPRRPRRDYSIDEKTDALFHEFLRHDPHFDDTPAAARHRARAHPHARKQWQRGRQHSDPGARAAPALAGTPAPPAGAARPARAPLRRGDSVDGPPDGRTLGGAGDDPAIPVIEEEPGGGGCPGSGLCVLPSGSVLDKLAAGLDERLFPPRLAEPVVATPALVAAAPTSPDHSPA

SEQ ID NO: 10701 - protein, 49 aa, Homo sapiens
  Payload ID: 2129;
  Gene Symbol: CBARP;
  Gene Name: calcium channel, voltage-dependent, beta subunit associated regulatory prt;
  ENSP ID: ENSP00000464878
MQPTATMATAATTTTTTTATVALTTSWDNATGRPTSQTPSWTTTCCWWW

SEQ ID NO: 10702 - protein, 453 aa, Homo sapiens
  Payload ID: 2129;
  Gene Symbol: CBARP;
  Gene Name: calcium channel, voltage-dependent, beta subunit associated regulatory prt;
  ENSP ID: ENSP00000465260
MQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRRYTLTEGDFHHLKNARLTHLHLPPLKIVTIHECDSGEASSATTPHPATSPKATLAIFQPPGKALTGRSVGPSSALPGDPYNSAAGATDFAEISPSASSDSGEGTSLDAGTRSTKAGGPGAAAGPGEAGPGSGAGTVLQFLTRLRRHASLDGASPYFKVKKWKLEPSQRAASLDTRGSPKRHHFQRQRAASESTEQEEGDAPQEDFIQYIARAGDAVAFPHPRPFLASPPPALGRYFSVDGGARGGPVGPCPPSPPPRRPRERSPGPVDTRSPASSGKAPPRGGLTGATSPAWTRGGKQGETG

SEQ ID NO: 10703 - protein, 91 aa, Homo sapiens
  Payload ID: 2129;
  Gene Symbol: CBARP;
  Gene Name: calcium channel, voltage-dependent, beta subunit associated regulatory prt;
  ENSP ID: ENSP00000466109
  MOD_RES (1)..(1): Any amino acid
XTSSTGRRVSFNEAALFEQSRKTQDKGRRYTLTEGDFHHLKNARLTHLHLPPLKIVTIHECDSGEASSATTPHPATSPKATLAIFQLRPAR

SEQ ID NO: 10704 - protein, 222 aa, Homo sapiens
  Payload ID: 2130;
  Gene Symbol: CACNG1;
  Gene Name: calcium channel, voltage-dependent, gamma subunit 1;
  Uniprot ID:  Q06432;
  ENSP ID: ENSP00000226021
MSQTKMLKVRVTLFCILAGIVLAMTAVVTDHWAVLSPHMEHHNTTCEAAHFGLWRICTKRIPMDDSKTCGPITLPGEKNCSYFRHFNPGESSEIFEFTTQKEYSISAAAIAIFSLGFIILGSLCVLLSLGKKRDYLLRPASMFYAFAGLCILVSVEVMRQSVKRMIDSEDTVWIEYYYSWSFACACAAFILLFLGGLALLLFSLPRMPRNPWESCMDAEPEH

SEQ ID NO: 10705 - protein, 323 aa, Homo sapiens
  Payload ID: 2131;
  Gene Symbol: CACNG2;
  Gene Name: calcium channel, voltage-dependent, gamma subunit 2;
  Uniprot ID:  Q9Y698;
  ENSP ID: ENSP00000300105
MGLFDRGVQMLLTTVGAFAAFSLMTIAVGTDYWLYSRGVCKTKSVSENETSKKNEEVMTHSGLWRTCCLEGNFKGLCKQIDHFPEDADYEADTAEYFLRAVRASSIFPILSVILLFMGGLCIAASEFYKTRHNIILSAGIFFVSAGLSNIIGIIVYISANAGDPSKSDSKKNSYSYGWSFYFGALSFIIAEMVGVLAVHMFIDRHKQLRATARATDYLQASAITRIPSYRYRYQRRSRSSSRSTEPSHSRDASPVGIKGFNTLPSTEISMYTLSRDPLKAATTPTATYNSDRDNSFLQVHNCIQKENKDSLHSNTANRRTTPV

SEQ ID NO: 10706 - protein, 315 aa, Homo sapiens
  Payload ID: 2132;
  Gene Symbol: CACNG3;
  Gene Name: calcium channel, voltage-dependent, gamma subunit 3;
  Uniprot ID:  O60359;
  ENSP ID: ENSP00000005284
MRMCDRGIQMLITTVGAFAAFSLMTIAVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 10707 - protein, 327 aa, Homo sapiens
  Payload ID: 2133;
  Gene Symbol: CACNG4;
  Gene Name: calcium channel, voltage-dependent, gamma subunit 4;
  Uniprot ID:  Q9UBN1;
  ENSP ID: ENSP00000262138
MVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 10708 - protein, 275 aa, Homo sapiens
  Payload ID: 2134;
  Gene Symbol: CACNG5;
  Gene Name: calcium channel, voltage-dependent, gamma subunit 5;
  Uniprot ID:  Q9UF02;
  ENSP ID: ENSP00000303092
MSACGRKALTLLSSVFAVCGLGLLGIAVSTDYWLYLEEGVIVPQNQSTEIKMSLHSGLWRVCFLAGEERGRCFTIEYVMPMNTQLTSESTVNVLKMIRSATPFPLVSLFFMFIGFILNNIGHIRPHRTILAFVSGIFFILSGLSLVVGLVLYISSINDEMLNRTKDAETYFNYKYGWSFAFAAISFLLTESAGVMSVYLFMKRYTAEDMYRPHPGFYRPRLSNCSDYSGQFLHPDAWVRGRSPSDISSEASLQMNSNYPALLKCPDYDQMSSSPC

SEQ ID NO: 10709 - protein, 275 aa, Homo sapiens; identical to SEQ ID NO: 10708
  Payload ID: 2134;
  Gene Symbol: CACNG5;
  Gene Name: calcium channel, voltage-dependent, gamma subunit 5;
  Uniprot ID:  Q9UF02;
  ENSP ID: ENSP00000436836

SEQ ID NO: 10710 - protein, 260 aa, Homo sapiens
  Payload ID: 2135;
  Gene Symbol: CACNG6;
  Gene Name: calcium channel, voltage-dependent, gamma subunit 6;
  Uniprot ID:  Q9BXT2;
  ENSP ID: ENSP00000252729
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKEVNLAAAVIAVLGLAVMALGCLCIIMVLSKGAEFLLRVGAVCFGLSGLLLLVSLEVFRHSVRALLQRVSPEPPPAPRLTYEYSWSLGCGVGAGLILLLGAGCFLLLTLPSWPWGSLCPKRGHRAT

SEQ ID NO: 10711 - protein, 214 aa, Homo sapiens
  Payload ID: 2135;
  Gene Symbol: CACNG6;
  Gene Name: calcium channel, voltage-dependent, gamma subunit 6;
  ENSP ID: ENSP00000319097
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGEANCTYFKFFTTGENARIFQRTTKKGLLLLVSLEVFRHSVRALLQRVSPEPPPAPRLTYEYSWSLGCGVGAGLILLLGAGCFLLLTLPSWPWGSLCPKRGHRAT

SEQ ID NO: 10712 - protein, 189 aa, Homo sapiens
  Payload ID: 2135;
  Gene Symbol: CACNG6;
  Gene Name: calcium channel, voltage-dependent, gamma subunit 6;
  ENSP ID: ENSP00000319135
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGGLLLLVSLEVFRHSVRALLQRVSPEPPPAPRLTYEYSWSLGCGVGAGLILLLGAGCFLLLTLPSWPWGSLCPKRGHRAT

SEQ ID NO: 10713 - protein, 275 aa, Homo sapiens
  Payload ID: 2136;
  Gene Symbol: CACNG7;
  Gene Name: calcium channel, voltage-dependent, gamma subunit 7;
  Uniprot ID:  P62955;
  ENSP ID: ENSP00000222212
MSHCSSRALTLLSSVFGACGLLLVGIAVSTDYWLYMEEGTVLPQNQTTEVKMALHAGLWRVCFFAGREKGRCVASEYFLEPEINLVTENTENILKTVRTATPFPMVSLFLVFTAFVISNIGHIRPQRTILAFVSGIFFILSGLSLVVGLVLYISSINDEVMNRPSSSEQYFHYRYGWSFAFAASSFLLKEGAGVMSVYLFTKRYAEEEMYRPHPAFYRPRLSDCSDYSGQFLQPEAWRRGRSPSDISSDVSIQMTQNYPPAIKYPDHLHISTSPC

SEQ ID NO: 10714 - protein, 198 aa, Homo sapiens
  Payload ID: 2136;
  Gene Symbol: CACNG7;
  Gene Name: calcium channel, voltage-dependent, gamma subunit 7;
  ENSP ID: ENSP00000375646
MSHCSSRALTLLSSVFGACGLLLVGIAVSTDYWLYMEEGTVLPQNQTTEVKMALHAGLWRVCFFAGREKGRCVASEYFLEPEINLVTENTENILKTVRTATPFPMVSLFLVFTAFVISNIGHIRPQRTILAFVSGIFFILSGLSLVVGLVLYISSINDEVMNRPSSSEQYFHYRYGWSFAFAASSFLLKEVTSVGPRL

SEQ ID NO: 10715 - protein, 275 aa, Homo sapiens; identical to SEQ ID NO: 10713
  Payload ID: 2136;
  Gene Symbol: CACNG7;
  Gene Name: calcium channel, voltage-dependent, gamma subunit 7;
  Uniprot ID:  P62955;
  ENSP ID: ENSP00000375647

SEQ ID NO: 10716 - protein, 425 aa, Homo sapiens
  Payload ID: 2137;
  Gene Symbol: CACNG8;
  Gene Name: calcium channel, voltage-dependent, gamma subunit 8;
  Uniprot ID:  Q8WXS5;
  ENSP ID: ENSP00000270458
LESLKRWNEERGLWCEKGVQVLLTTVGAFAAFGLMTIAISTDYWLYTRALICNTTNLTAGGDDGTPHRGGGGASEKKDPGGLTHSGLWRICCLEGLKRGVCVKINHFPEDTDYDHDSAEYLLRVVRASSIFPILSAILLLLGGVCVAASRVYKSKRNIILGAGILFVAAGLSNIIGVIVYISANAGEPGPKRDEEKKNHYSYGWSFYFGGLSFILAEVIGVLAVNIYIERSREAHCQSRSDLLKAGGGAGGSGGSGPSAILRLPSYRFRYRRRSRSSSRSSEPSPSRDASPGGPGGPGFASTDISMYTLSRDPSKGSVAAGLAGAGGGGGGAVGAFGGAAGGAGGGGGGGGGAGAERDRGGASGFLTLHNAFPKEAGGGVTVTVTGPPAPPAPAPPAPSAPAPGTLAKEAAASNTNTLNRKTTPV

SEQ ID NO: 10717 - protein, 2186 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000266376
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10718 - protein, 2173 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000329877
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10719 - protein, 2163 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000336982
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNRGTPAGMLDQKKGKFAWFSHSTETHVSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10720 - protein, 2179 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000341092
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMGPSCSHPPLAVLTAPPVADGFQNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10721 - protein, 2146 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382500
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10722 - protein, 2146 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382504
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10723 - protein, 2138 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382506
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10724 - protein, 2138 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382510
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10725 - protein, 2138 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382512
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10726 - protein, 2158 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382515
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10727 - protein, 2173 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000382526
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10728 - protein, 2157 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382530
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10729 - protein, 2155 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382537
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10730 - protein, 2209 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000382542
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10731 - protein, 2157 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382546
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10732 - protein, 2166 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382547
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10733 - protein, 2138 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382549
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10734 - protein, 2138 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382552
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10735 - protein, 2144 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382557
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITENAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10736 - protein, 2138 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000382563
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10737 - protein, 2157 aa, Homo sapiens
  Payload ID: 2138;
  Gene Symbol: CACNA1C;
  Gene Name: calcium channel, voltage-dependent, L type, alpha 1C subunit;
  Uniprot ID:  Q13936;
  ENSP ID: ENSP00000385724
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10738 - protein, 2209 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000385896
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10739 - protein, 1279 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000437936
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKVGL

SEQ ID NO: 10740 - protein, 100 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000445849
MLRAFVQPGTPAYQPLPSHLSANTEVKFKGTLVHEAQLNYFYISPGGSNYGSPRPAHANMNANAAAGLAPEHIPTPGAALSWQAAIDAARQAKLMGSAGN

SEQ ID NO: 10741 - protein, 243 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000478996
  MOD_RES (1)..(1): Any amino acid
XSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHVCIACVFCTPSPWGCARPTASVADIIVQSGAQF

SEQ ID NO: 10742 - protein, 2039 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000479029
ERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10743 - protein, 144 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000479274
MAYVCKLLMSKTRPLVMIGVAWVMLLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQ

SEQ ID NO: 10744 - protein, 2027 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000480292
ERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10745 - protein, 2062 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000480922
ERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10746 - protein, 829 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000482910
MFIVSQNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10747 - protein, 2014 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000483335
ERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10748 - protein, 2014 aa, Homo sapiens
  Payload ID: 2138;
  Gene Symbol: CACNA1C;
  Gene Name: calcium channel, voltage-dependent, L type, alpha 1C subunit;
  ENSP ID: ENSP00000484796
ERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 10749 - protein, 2161 aa, Homo sapiens
  Payload ID: 2139;
  Gene Symbol: CACNA1D;
  Gene Name: calcium channel, voltage-dependent, L type, alpha 1D subunit;
  Uniprot ID:  Q01668;
  ENSP ID: ENSP00000288133
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 10750 - protein, 2181 aa, Homo sapiens
  Payload ID: 2139;
  Gene Symbol: CACNA1D;
  Gene Name: calcium channel, voltage-dependent, L type, alpha 1D subunit;
  Uniprot ID:  Q01668;
  ENSP ID: ENSP00000288139
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 10751 - protein, 2137 aa, Homo sapiens
  Payload ID: 2139;
  Gene Symbol: CACNA1D;
  Gene Name: calcium channel, voltage-dependent, L type, alpha 1D subunit;
  Uniprot ID:  Q01668;
  ENSP ID: ENSP00000409174
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 10752 - protein, 1854 aa, Homo sapiens
  Payload ID: 2139;
  Gene Symbol: CACNA1D;
  Gene Name: calcium channel, voltage-dependent, L type, alpha 1D subunit;
  ENSP ID: ENSP00000418014
ANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKHYFTDAWNTFDALIVVGSVVDIAITEVNPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 10753 - protein, 264 aa, Homo sapiens
  Payload ID: 2139;
  Gene Symbol: CACNA1D;
  Gene Name: calcium channel, voltage-dependent, L type, alpha 1D subunit;
  ENSP ID: ENSP00000418045
  MOD_RES (1)..(1): Any amino acid
XPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNRVTVADLLKEDKKKKKFCCFRQRRAKDHASMPTSETESVNTENVSGEGENRGCCGSLCQAISKSKLSRRWRRWNRFNRRRCRAAVKSVTFYWLVIVLVFLNTLTISSEHYNQPDW

SEQ ID NO: 10754 - protein, 1966 aa, Homo sapiens
  Payload ID: 2140;
  Gene Symbol: CACNA1F;
  Gene Name: calcium channel, voltage-dependent, L type, alpha 1F subunit;
  Uniprot ID:  O60840;
  ENSP ID: ENSP00000321618
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 10755 - protein, 1912 aa, Homo sapiens
  Payload ID: 2140;
  Gene Symbol: CACNA1F;
  Gene Name: calcium channel, voltage-dependent, L type, alpha 1F subunit;
  Uniprot ID:  O60840;
  ENSP ID: ENSP00000365427
MSESEGGKGERILPSLQTLGASIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 10756 - protein, 1977 aa, Homo sapiens
  Payload ID: 2140;
  Gene Symbol: CACNA1F;
  Gene Name: calcium channel, voltage-dependent, L type, alpha 1F subunit;
  Uniprot ID:  O60840;
  ENSP ID: ENSP00000365441
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 10757 - protein, 116 aa, Homo sapiens
  Payload ID: 2140;
  Gene Symbol: CACNA1F;
  Gene Name: calcium channel, voltage-dependent, L type, alpha 1F subunit;
  ENSP ID: ENSP00000418961
DYFRKFRRRKEKGLLGNDAAPSTSSALQAGLRSLQDLGPEMRQALTCDTEEEEEEGQEGVEEEDEKDLETNKVGTSFHSPRNLIVKYFVNPLSDFDTASGKKLPQRSPLCNRKIFI

SEQ ID NO: 10758 - protein, 1873 aa, Homo sapiens
  Payload ID: 2141;
  Gene Symbol: CACNA1S;
  Gene Name: calcium channel, voltage-dependent, L type, alpha 1S subunit;
  Uniprot ID:  Q13698;
  ENSP ID: ENSP00000355192
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 10759 - protein, 1854 aa, Homo sapiens
  Payload ID: 2141;
  Gene Symbol: CACNA1S;
  Gene Name: calcium channel, voltage-dependent, L type, alpha 1S subunit;
  ENSP ID: ENSP00000356307
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 10760 - protein, 2237 aa, Homo sapiens [sequence omitted]

SEQ ID NO: 10761 - protein, 2237 aa, Homo sapiens
  Payload ID: 2142;
  Gene Symbol: CACNA1B;
  Gene Name: calcium channel, voltage-dependent, N type, alpha 1B subunit;
  Uniprot ID:  Q00975;
  ENSP ID: ENSP00000277551
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQAGSAVGFPNTTPCCRETPSASPWPLALELALTLTWGSVWTVRPLSTPCLRTLSLSRRLWPPTRAAPPGLPTCPP

SEQ ID NO: 10762 - protein, 2340 aa, Homo sapiens
  Payload ID: 2142;
  Gene Symbol: CACNA1B;
  Gene Name: calcium channel, voltage-dependent, N type, alpha 1B subunit;
  ENSP ID: ENSP00000360406
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDAVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 10763 - protein, 2338 aa, Homo sapiens
  Payload ID: 2142;
  Gene Symbol: CACNA1B;
  Gene Name: calcium channel, voltage-dependent, N type, alpha 1B subunit;
  ENSP ID: ENSP00000360408
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDAVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 10764 - protein, 2337 aa, Homo sapiens
  Payload ID: 2142;
  Gene Symbol: CACNA1B;
  Gene Name: calcium channel, voltage-dependent, N type, alpha 1B subunit;
  ENSP ID: ENSP00000360414
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 10765 - protein, 2339 aa, Homo sapiens [sequence omitted]

SEQ ID NO: 10766 - protein, 164 aa, Homo sapiens
  Payload ID: 2142;
  Gene Symbol: CACNA1B;
  Gene Name: calcium channel, voltage-dependent, N type, alpha 1B subunit;
  ENSP ID: ENSP00000413042
  MOD_RES (1)..(1): Any amino acid
XNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACCRIHYKDMYSLLRCIAPPVGLGKNCPRRLAYKRLVRMNMPISNEDMTVHFTSTLMALI

SEQ ID NO: 10767 - protein, 2506 aa, Homo sapiens
  Payload ID: 2143;
  Gene Symbol: CACNA1A;
  Gene Name: calcium channel, voltage-dependent, P/Q type, alpha 1A subunit;
  Uniprot ID:  O00555;
  ENSP ID: ENSP00000353362
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 10768 - protein, 103 aa, Homo sapiens
  Payload ID: 2143;
  Gene Symbol: CACNA1A;
  Gene Name: calcium channel, voltage-dependent, P/Q type, alpha 1A subunit;
  ENSP ID: ENSP00000459963
MSSWPTRPTKSTAPPRPGGKNGTTIIANCIVLALEQHLPDDDKTPMSERLDDTEPYFIGIFCFEAGIKIIALGFAFHKGSYLRNGWNVMDFVVVLTGILATVG

SEQ ID NO: 10769 - protein, 2261 aa, Homo sapiens
  Payload ID: 2143;
  Gene Symbol: CACNA1A;
  Gene Name: calcium channel, voltage-dependent, P/Q type, alpha 1A subunit;
  Uniprot ID:  O00555;
  ENSP ID: ENSP00000460092
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 10770 - protein, 79 aa, Homo sapiens
  Payload ID: 2143;
  Gene Symbol: CACNA1A;
  Gene Name: calcium channel, voltage-dependent, P/Q type, alpha 1A subunit;
  ENSP ID: ENSP00000460276
  MOD_RES (1)..(1): Any amino acid
XKFYGASVAYENALRVFNIVFTSLFSLECVLKVMAFGILNYFRDAWNIFDFVTVLGSITDILVTEFGAWSRATPPSPRS

SEQ ID NO: 10771 - protein, 35 aa, Homo sapiens
  Payload ID: 2143;
  Gene Symbol: CACNA1A;
  Gene Name: calcium channel, voltage-dependent, P/Q type, alpha 1A subunit;
  ENSP ID: ENSP00000464729
MSSWPTRPTKSTAPPRPGGKNGRSYQRMCFTQTRE

SEQ ID NO: 10772 - protein, 1180 aa, Homo sapiens
  Payload ID: 2143;
  Gene Symbol: CACNA1A;
  Gene Name: calcium channel, voltage-dependent, P/Q type, alpha 1A subunit;
  ENSP ID: ENSP00000465598
LDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 10773 - protein, 981 aa, Homo sapiens
  Payload ID: 2143;
  Gene Symbol: CACNA1A;
  Gene Name: calcium channel, voltage-dependent, P/Q type, alpha 1A subunit;
  ENSP ID: ENSP00000467729
QEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 10774 - protein, 2512 aa, Homo sapiens
  Payload ID: 2143;
  Gene Symbol: CACNA1A;
  Gene Name: calcium channel, voltage-dependent, P/Q type, alpha 1A subunit;
  ENSP ID: ENSP00000479983
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 10775 - protein, 2312 aa, Homo sapiens [sequence omitted]

SEQ ID NO: 10776 - protein, 2251 aa, Homo sapiens
  Payload ID: 2144;
  Gene Symbol: CACNA1E;
  Gene Name: calcium channel, voltage-dependent, R type, alpha 1E subunit;
  Uniprot ID:  Q15878;
  ENSP ID: ENSP00000351101
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 10777 - protein, 2294 aa, Homo sapiens
  Payload ID: 2144;
  Gene Symbol: CACNA1E;
  Gene Name: calcium channel, voltage-dependent, R type, alpha 1E subunit;
  ENSP ID: ENSP00000353222
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 10778 - protein, 2270 aa, Homo sapiens
  Payload ID: 2144;
  Gene Symbol: CACNA1E;
  Gene Name: calcium channel, voltage-dependent, R type, alpha 1E subunit;
  Uniprot ID:  Q15878;
  ENSP ID: ENSP00000356539
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 10779 - protein, 2270 aa, Homo sapiens; identical to SEQ ID NO: 10778
  Payload ID: 2144;
  Gene Symbol: CACNA1E;
  Gene Name: calcium channel, voltage-dependent, R type, alpha 1E subunit;
  Uniprot ID:  Q15878;
  ENSP ID: ENSP00000356542

SEQ ID NO: 10780 - protein, 2313 aa, Homo sapiens
  Payload ID: 2144;
  Gene Symbol: CACNA1E;
  Gene Name: calcium channel, voltage-dependent, R type, alpha 1E subunit;
  Uniprot ID:  Q15878;
  ENSP ID: ENSP00000356545
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 10781 - protein, 438 aa, Homo sapiens
  Payload ID: 2144;
  Gene Symbol: CACNA1E;
  Gene Name: calcium channel, voltage-dependent, R type, alpha 1E subunit;
  ENSP ID: ENSP00000432038
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSV

SEQ ID NO: 10782 - protein, 2251 aa, Homo sapiens; identical to SEQ ID NO: 10776
  Payload ID: 2144;
  Gene Symbol: CACNA1E;
  Gene Name: calcium channel, voltage-dependent, R type, alpha 1E subunit;
  Uniprot ID:  Q15878;
  ENSP ID: ENSP00000481619

SEQ ID NO: 10783 - protein, 2313 aa, Homo sapiens; identical to SEQ ID NO: 10780
  Payload ID: 2144;
  Gene Symbol: CACNA1E;
  Gene Name: calcium channel, voltage-dependent, R type, alpha 1E subunit;
  Uniprot ID:  Q15878;
  ENSP ID: ENSP00000483914

SEQ ID NO: 10784 - protein, 2250 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000339302
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10785 - protein, 2343 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000347078
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10786 - protein, 2171 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000350979
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10787 - protein, 2377 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000352011
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10788 - protein, 2261 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000353990
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10789 - protein, 1555 aa, Homo sapiens
  Payload ID: 2145;
  Gene Symbol: CACNA1G;
  Gene Name: calcium channel, voltage-dependent, T type, alpha 1G subunit;
  ENSP ID: ENSP00000392390
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQVSPRLRGGAVVKEAGGGTGPCLVIPADSGGGGLHEEISPSHPLLSNHQHVAKPSPSHSAPKSGPMGSLAVLKDEETEAQRG

SEQ ID NO: 10790 - protein, 2243 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000409759
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10791 - protein, 2266 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000414388
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10792 - protein, 2366 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000420918
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10793 - protein, 2194 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000421518
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10794 - protein, 2205 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000422268
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10795 - protein, 2227 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000422407
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10796 - protein, 2277 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000423045
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10797 - protein, 2332 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000423112
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10798 - protein, 2314 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000423155
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10799 - protein, 2291 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000423317
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMADLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10800 - protein, 1746 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000424664
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTLWAWSSLETWSVTRHTPVRAWAVMPPFGTLAWPS

SEQ ID NO: 10801 - protein, 1765 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000425153
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 10802 - protein, 2239 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000425451
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10803 - protein, 2306 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000425522
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10804 - protein, 2259 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000425698
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10805 - protein, 2284 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426098
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10806 - protein, 2287 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426172
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10807 - protein, 2321 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426232
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10808 - protein, 2273 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426261
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10809 - protein, 1776 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426313
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 10810 - protein, 1735 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426558
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 10811 - protein, 2232 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000426814
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10812 - protein, 2298 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000427173
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10813 - protein, 1753 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000427231
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 10814 - protein, 2250 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000427238
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 10815 - protein, 1758 aa, Homo sapiens
  Payload ID: 2145;
  Gene Symbol: CACNA1G;
  Gene Name: calcium channel, voltage-dependent, T type, alpha 1G subunit;
  Uniprot ID:  O43497;
  ENSP ID: ENSP00000427247
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 10816 - protein, 337 aa, Homo sapiens
  Payload ID: 2145;
  Gene Symbol: CACNA1G;
  Gene Name: calcium channel, voltage-dependent, T type, alpha 1G subunit;
  ENSP ID: ENSP00000427697
TASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQVGLRWAGSICGLRSLSMG

SEQ ID NO: 10817 - protein, 277 aa, Homo sapiens
  Payload ID: 2145;
  Gene Symbol: CACNA1G;
  Gene Name: calcium channel, voltage-dependent, T type, alpha 1G subunit;
  ENSP ID: ENSP00000459988
AFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIFLALRTSPVERASII

SEQ ID NO: 10818 - protein, 2353 aa, Homo sapiens
  Payload ID: 2146;
  Gene Symbol: CACNA1H;
  Gene Name: calcium channel, voltage-dependent, T type, alpha 1H subunit;
  Uniprot ID:  O95180;
  ENSP ID: ENSP00000334198
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 10819 - protein, 2347 aa, Homo sapiens
  Payload ID: 2146;
  Gene Symbol: CACNA1H;
  Gene Name: calcium channel, voltage-dependent, T type, alpha 1H subunit;
  Uniprot ID:  O95180;
  ENSP ID: ENSP00000351401
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRKAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 10820 - protein, 1078 aa, Homo sapiens
  Payload ID: 2146;
  Gene Symbol: CACNA1H;
  Gene Name: calcium channel, voltage-dependent, T type, alpha 1H subunit;
  ENSP ID: ENSP00000454581
  MOD_RES (1)..(1): Any amino acid
XPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRKAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 10821 - protein, 1100 aa, Homo sapiens
  Payload ID: 2146;
  Gene Symbol: CACNA1H;
  Gene Name: calcium channel, voltage-dependent, T type, alpha 1H subunit;
  ENSP ID: ENSP00000454990
  MOD_RES (1)..(1): Any amino acid
XPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSKALPVAVAVAEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 10822 - protein, 897 aa, Homo sapiens
  Payload ID: 2146;
  Gene Symbol: CACNA1H;
  Gene Name: calcium channel, voltage-dependent, T type, alpha 1H subunit;
  ENSP ID: ENSP00000455512
  MOD_RES (1)..(1): Any amino acid
XFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRKAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 10823 - protein, 2347 aa, Homo sapiens; identical to SEQ ID NO: 10819
  Payload ID: 2146;
  Gene Symbol: CACNA1H;
  Gene Name: calcium channel, voltage-dependent, T type, alpha 1H subunit;
  Uniprot ID:  O95180;
  ENSP ID: ENSP00000455840

SEQ ID NO: 10824 - protein, 1084 aa, Homo sapiens
  Payload ID: 2146;
  Gene Symbol: CACNA1H;
  Gene Name: calcium channel, voltage-dependent, T type, alpha 1H subunit;
  ENSP ID: ENSP00000457555
  MOD_RES (1)..(1): Any amino acid
XPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 10825 - protein, 2016 aa, Homo sapiens
  Payload ID: 2147;
  Gene Symbol: CACNA1I;
  Gene Name: calcium channel, voltage-dependent, T type, alpha 1I subunit;
  Uniprot ID:  Q9P0X4;
  ENSP ID: ENSP00000383887
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQVPTPPRP

SEQ ID NO: 10826 - protein, 2188 aa, Homo sapiens
  Payload ID: 2147;
  Gene Symbol: CACNA1I;
  Gene Name: calcium channel, voltage-dependent, T type, alpha 1I subunit;
  Uniprot ID:  Q9P0X4;
  ENSP ID: ENSP00000384093
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 10827 - protein, 2223 aa, Homo sapiens
  Payload ID: 2147;
  Gene Symbol: CACNA1I;
  Gene Name: calcium channel, voltage-dependent, T type, alpha 1I subunit;
  Uniprot ID:  Q9P0X4;
  ENSP ID: ENSP00000385019
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 10828 - protein, 1981 aa, Homo sapiens
  Payload ID: 2147;
  Gene Symbol: CACNA1I;
  Gene Name: calcium channel, voltage-dependent, T type, alpha 1I subunit;
  Uniprot ID:  Q9P0X4;
  ENSP ID: ENSP00000385680
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQVPTPPRP

SEQ ID NO: 10829 - protein, 927 aa, Homo sapiens
  Payload ID: 2148;
  Gene Symbol: CHERP;
  Gene Name: calcium homeostasis endoplasmic reticulum prt;
  ENSP ID: ENSP00000198939
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHWALTRGKSLPHSQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 10830 - protein, 916 aa, Homo sapiens
  Payload ID: 2148;
  Gene Symbol: CHERP;
  Gene Name: calcium homeostasis endoplasmic reticulum prt;
  Uniprot ID:  Q8IWX8;
  ENSP ID: ENSP00000439856
MEMPLPPDDQELRNVIDKLAQFVARNGPEFEKMTMEKQKDNPKFSFLFGGEFYSYYKCKLALEQQQLICKQQTPELEPAATMPPLPQPPLAPAAPIPPAQGAPSMDELIQQSQWNLQQQEQHLLALRQEQVTAAVAHAVEQQMQKLLEETQLDMNEFDNLLQPIIDTCTKDAISAGKNWMFSNAKSPPHCELMAGHLRNRITADGAHFELRLHLIYLINDVLHHCQRKQARELLAALQKVVVPIYCTSFLAVEEDKQQKIARLLQLWEKNGYFDDSIIQQLQSPALGLGQYQATLINEYSSVVQPVQLAFQQQIQTLKTQHEEFVTSLAQQQQQQQQQQQQLQMPQMEAEVKATPPPPAPPPAPAPAPAIPPTTQPDDSKPPIQMPGSSEYEAPGGVQDPAAAGPRGPGPHDQIPPNKPPWFDQPHPVAPWGQQQPPEQPPYPHHQGGPPHCPPWNNSHEGMWGEQRGDPGWNGQRDAPWNNQPDAAWNSQFEGPWNSQHEQPPWGGGQREPPFRMQRPPHFRGPFPPHQQHPQFNQPPHPHNFNRFPPRFMQDDFPPRHPFERPPYPHRFDYPQGDFPAEMGPPHHHPGHRMPHPGINEHPPWAGPQHPDFGPPPHGFNGQPPHMRRQGPPHINHDDPSLVPNVPYFDLPAGLMAPLVKLEDHEYKPLDPKDIRLPPPMPPSERLLAAVEAFYSPPSHDRPRNSEGWEQNGLYEFFRAKMRARRRKGQEKRNSGPSRSRSRSKSRGRSSSRSNSRSSKSSGSYSRSRSRSCSRSYSRSRSRSRSRSRSSRSRSRSQSRSRSKSYSPGRRRRSRSRSPTPPSSAGLGSNSAPPIPDSRLGEENKGHQMLVKMGWSGSGGLGAKEQGIQDPIKGGDVRDKWDQYKGVGVALDDPYENYRRNKSYSFIARMKARDECK

SEQ ID NO: 10831 - protein, 346 aa, Homo sapiens
  Payload ID: 2149;
  Gene Symbol: CALHM1;
  Gene Name: calcium homeostasis modulator 1;
  Uniprot ID:  Q8IU99;
  ENSP ID: ENSP00000329926
MMDKFRMIFQFLQSNQESFMNGICGIMALASAQMYSAFDFNCPCLPGYNAAYSAGILLAPPLVLFLLGLVMNNNVSMLAEEWKRPLGRRAKDPAVLRYMFCSMAQRALIAPVVWVAVTLLDGKCFLCAFCTAVPVSALGNGSLAPGLPAPELARLLARVPCPEIYDGDWLLAREVAVRYLRCISQALGWSFVLLTTLLAFVVRSVRPCFTQAAFLKSKYWSHYIDIERKLFDETCTEHAKAFAKVCIQQFFEAMNHDLELGHTHGTLATAPASAAAPTTPDGAEEEREKLRGITDQGTMNRLLTSWHKCKPPLRLGQEEPPLMGNGWAGGGPRPPRKEVATYFSKV

SEQ ID NO: 10832 - protein, 323 aa, Homo sapiens
  Payload ID: 2150;
  Gene Symbol: CALHM2;
  Gene Name: calcium homeostasis modulator 2;
  Uniprot ID:  Q9HA72;
  ENSP ID: ENSP00000260743
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 10833 - protein, 323 aa, Homo sapiens; identical to SEQ ID NO: 10832
  Payload ID: 2150;
  Gene Symbol: CALHM2;
  Gene Name: calcium homeostasis modulator 2;
  Uniprot ID:  Q9HA72;
  ENSP ID: ENSP00000358803

SEQ ID NO: 10834 - protein, 344 aa, Homo sapiens
  Payload ID: 2151;
  Gene Symbol: CALHM3;
  Gene Name: calcium homeostasis modulator 3;
  Uniprot ID:  Q86XJ0;
  ENSP ID: ENSP00000358798
MDKFRMLFQHFQSSSESVMNGICLLLAAVTVKLYSSFDFNCPCLVHYNALYGLGLLLTPPLALFLCGLLANRQSVVMVEEWRRPAGHRRKDPGIIRYMCSSVLQRALAAPLVWILLALLDGKCFVCAFSSSVDPEKFLDFANMTPSQVQLFLAKVPCKEDELVRDSPARKAVSRYLRCLSQAIGWSVTLLLIIAAFLARCLRPCFDQTVFLQRRYWSNYVDLEQKLFDETCCEHARDFAHRCVLHFFASMRSELQARGLRRGNAGRRLELPAVPEPPEGLDSGSGKAHLRAISSREQVDRLLSTWYSSKPPLDLAASPGLCGGGLSHRAPTLALGTRLSQHTDV

SEQ ID NO: 10835 - protein, 296 aa, Homo sapiens
  Payload ID: 2152;
  Gene Symbol: CAMLG;
  Gene Name: calcium modulating ligand;
  Uniprot ID:  P49069;
  ENSP ID: ENSP00000297156
MESMAVATDGGERPGVPAGSGLSASQRRAELRRRKLLMNSEQRINRIMGFHRPGSGAEEESQTKSKQQDSDKLNSLSVPSVSKRVVLGDSVSTGTTDQQGGVAEVKGTQLGDKLDSFIKPPECSSDVNLELRQRNRGDLTADSVQRGSRHGLEQYLSRFEEAMKLRKQLISEKPSQEDGNTTEEFDSFRIFRLVGCALLALGVRAFVCKYLSIFAPFLTLQLAYMGLYKYFPKSEKKIKTTVLTAALLLSGIPAEVINRSMDTYSKMGEVFTDLCVYFFTFIFCHELLDYWGSEVP

SEQ ID NO: 10836 - protein, 80 aa, Homo sapiens
  Payload ID: 2152;
  Gene Symbol: CAMLG;
  Gene Name: calcium modulating ligand;
  ENSP ID: ENSP00000427331
MESMAVATDGGERPGVPAGSGLSASQRRAELRRRKLLMNSEQRINRIMGFHRPGSGAVHICSISYFTTCVHGIIQIFSQE

SEQ ID NO: 10837 - protein, 147 aa, Homo sapiens
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000311847
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 10838 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000379838

SEQ ID NO: 10839 - protein, 131 aa, Homo sapiens
  Payload ID: 2153;
  Gene Symbol: CARHSP1;
  Gene Name: calcium regulated heat stable prt 1, 24kDa;
  ENSP ID: ENSP00000455016
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHL

SEQ ID NO: 10840 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000455284

SEQ ID NO: 10841 - protein, 125 aa, Homo sapiens
  Payload ID: 2153;
  Gene Symbol: CARHSP1;
  Gene Name: calcium regulated heat stable prt 1, 24kDa;
  ENSP ID: ENSP00000455522
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVE

SEQ ID NO: 10842 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000455855

SEQ ID NO: 10843 - protein, 114 aa, Homo sapiens
  Payload ID: 2153;
  Gene Symbol: CARHSP1;
  Gene Name: calcium regulated heat stable prt 1, 24kDa;
  ENSP ID: ENSP00000455988
MPPPPEGQPCHLSLPHHHSPPPIKLQSGCWTPLGAVSAHHPLCGATWSQAHCPLAGRGPSRRRCGLHRAPSTKESANASAGPRAMASLLQLMAAPTSSCTSLMWKGSMSQWKAT

SEQ ID NO: 10844 - protein, 112 aa, Homo sapiens
  Payload ID: 2153;
  Gene Symbol: CARHSP1;
  Gene Name: calcium regulated heat stable prt 1, 24kDa;
  ENSP ID: ENSP00000456909
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMC

SEQ ID NO: 10845 - protein, 71 aa, Homo sapiens
  Payload ID: 2153;
  Gene Symbol: CARHSP1;
  Gene Name: calcium regulated heat stable prt 1, 24kDa;
  ENSP ID: ENSP00000457213
MSSEPPPPPQPPTHQASVGLLDTPRSRERSPSPLRGNVVPSPLPTRRTRTFSATVRASQGPVYKGVCKCFC

SEQ ID NO: 10846 - protein, 124 aa, Homo sapiens
  Payload ID: 2153;
  Gene Symbol: CARHSP1;
  Gene Name: calcium regulated heat stable prt 1, 24kDa;
  ENSP ID: ENSP00000457864
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAV

SEQ ID NO: 10847 - protein, 94 aa, Homo sapiens
  Payload ID: 2153;
  Gene Symbol: CARHSP1;
  Gene Name: calcium regulated heat stable prt 1, 24kDa;
  ENSP ID: ENSP00000460812
MSSEPPPPPQPPTHQASVGLLDTPRSRERSPSPLRGNVVPSPLPTRRTRTFSATVRASQGPVYKGVCKCFCRSKGHGFITPADGGPDIFLHISE

SEQ ID NO: 10848 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000478055

SEQ ID NO: 10849 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000480144

SEQ ID NO: 10850 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000480542

SEQ ID NO: 10851 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000481550

SEQ ID NO: 10852 - protein, 147 aa, Homo sapiens; identical to SEQ ID NO: 10837
  Payload ID: 2153;
  Gene Symbol: CARHSP1;
  Gene Name: calcium regulated heat stable prt 1, 24kDa;
  Uniprot ID:  Q9Y2V2;
  ENSP ID: ENSP00000483591

SEQ ID NO: 10853 - protein, 395 aa, Homo sapiens
  Payload ID: 2154;
  Gene Symbol: CRACR2A;
  Gene Name: calcium release activated channel regulator 2A;
  Uniprot ID:  Q9BSW2;
  ENSP ID: ENSP00000252322
MAAPDGRVVSRPQRLGQGSGQGPKGSGACLHPLDSLEQKETQEQTSGQLVMLRKAQEFFQTCDAEGKGFIARKDMQRLHKELPLSLEELEDVFDALDADGNGYLTPQEFTTGFSHFFFSQNNPSQEDAGEQVAQRHEEKVYLSRGDEDLGDMGEDEEAQFRMLMDRLGAQKVLEDESDVKQLWLQLKKEEPHLLSNFEDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRCVGGHWPVLRAPPRSLGSEGPV

SEQ ID NO: 10854 - protein, 198 aa, Homo sapiens
  Payload ID: 2154;
  Gene Symbol: CRACR2A;
  Gene Name: calcium release activated channel regulator 2A;
  ENSP ID: ENSP00000331047
  MOD_RES (1)..(1): Any amino acid
XDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRCVGGHWPVLRAPPRSLGSEGPV

SEQ ID NO: 10855 - protein, 731 aa, Homo sapiens
  Payload ID: 2154;
  Gene Symbol: CRACR2A;
  Gene Name: calcium release activated channel regulator 2A;
  Uniprot ID:  Q9BSW2;
  ENSP ID: ENSP00000409382
MAAPDGRVVSRPQRLGQGSGQGPKGSGACLHPLDSLEQKETQEQTSGQLVMLRKAQEFFQTCDAEGKGFIARKDMQRLHKELPLSLEELEDVFDALDADGNGYLTPQEFTTGFSHFFFSQNNPSQEDAGEQVAQRHEEKVYLSRGDEDLGDMGEDEEAQFRMLMDRLGAQKVLEDESDVKQLWLQLKKEEPHLLSNFEDFLTRIISQLQEAHEEKNELECALKRKIAAYDEEIQHLYEEMEQQIKSEKEQFLLKDTERFQARSQELEQKLLCKEQELEQLTQKQKRLEGQCTALHHDKHETKAENTKLKLTNQELARELERTSWELQDAQQQLESLQQEACKLHQEKEMEVYRVTESLQREKAGLLKQLDFLRERNKHLRDERDICFQKNKAAKANTAASRASWKKRSGSVIGKYVDSRGILRSQSEEEEEVFGIPRRSSLGLSGYPLTEEEPGTGEPGPGGPYPRPLRRIISVEEDPLPQLLDGGFEQPLSKCSEEEEVSDQGVQGQIPEAPPLKLTPTSPRGQPVGKEALCKEESSPSAPDRLFKIVFVGNSAVGKTSFLRRFCEDRFSPGMAATVGIDYRVKTLNVDNSQVALQLWDTAGQERYRCITQQFFRKADGVIVMYDLTDKQSFLSVRRWLSSVEEAVGDRVPVLLLGNKLDNEKEREVPRGLGEQLATENNLIFYECSAYSGHNTKESLLHLARFLKEQEDTVREDTIQVGHPAKKKSCCG

SEQ ID NO: 10856 - protein, 118 aa, Homo sapiens
  Payload ID: 2154;
  Gene Symbol: CRACR2A;
  Gene Name: calcium release activated channel regulator 2A;
  ENSP ID: ENSP00000438777
  MOD_RES (1)..(1): Any amino acid
XEKEMEVYRVTESLQREKAGLLKQLDFLRERNKHLRDERDICFQKNKAAKANTAASRASWKKRSGSVIGKYVDSRGILRRWPQRDRGIPTLQYQTQRDLEDCKHEMKKICKAEVTLEM

SEQ ID NO: 10857 - protein, 294 aa, Homo sapiens
  Payload ID: 2155;
  Gene Symbol: CRACR2B;
  Gene Name: calcium release activated channel regulator 2B;
  Uniprot ID:  Q8N4Y2;
  ENSP ID: ENSP00000409256
MASPGKPGADEAQEEEGELEGGSAGPRAAILEQAEELFLLCDKEAKGFITKHDLQGLQSDLPLTPEQLEAVFESLDRAHTGFLTAREFCLGLGMFVGVASAQGANPCRTPEETFESGGLDVQGTAGSLDEEEEEEERFHTVLEQLGVAPVLGKQRAVRTLWARLQRERPELLGSFEDVLIRASACLEEAARERDGLEQALRRRESEHEREVRALYEETEQLREQSRRPPSQNFARGERRSRLELELQSREQDLERAGLRQRERRGRRLQEHAERESQPATATGAAQGAEYTAAG

SEQ ID NO: 10858 - protein, 294 aa, Homo sapiens; identical to SEQ ID NO: 10857
  Payload ID: 2155;
  Gene Symbol: CRACR2B;
  Gene Name: calcium release activated channel regulator 2B;
  Uniprot ID:  Q8N4Y2;
  ENSP ID: ENSP00000432334

SEQ ID NO: 10859 - protein, 88 aa, Homo sapiens
  Payload ID: 2155;
  Gene Symbol: CRACR2B;
  Gene Name: calcium release activated channel regulator 2B;
  ENSP ID: ENSP00000432726
MASPGKPGADEAQEEEGELEGGSAGPRAAILEQAEELFLLCDKEAKGFITKHDLQGLQSDLPLTPEQLEAVFESLDRAHTGFLTAREF

SEQ ID NO: 10860 - protein, 81 aa, Homo sapiens
  Payload ID: 2155;
  Gene Symbol: CRACR2B;
  Gene Name: calcium release activated channel regulator 2B;
  ENSP ID: ENSP00000433602
MASPGKPGADEAQEEEGELEGGSAGPRAAILEQAEELFLLCDKEAKGFITKHDLQGLQSDLPLTPEQLEAVFESLDRAHTG

SEQ ID NO: 10861 - protein, 34 aa, Homo sapiens
  Payload ID: 2155;
  Gene Symbol: CRACR2B;
  Gene Name: calcium release activated channel regulator 2B;
  ENSP ID: ENSP00000434198
MASPGKPGADEAQEEEGELEGGSAGPRAAILEQA

SEQ ID NO: 10862 - protein, 399 aa, Homo sapiens
  Payload ID: 2155;
  Gene Symbol: CRACR2B;
  Gene Name: calcium release activated channel regulator 2B;
  Uniprot ID:  Q8N4Y2;
  ENSP ID: ENSP00000435299
MASPGKPGADEAQEEEGELEGGSAGPRAAILEQAEELFLLCDKEAKGFITKHDLQGLQSDLPLTPEQLEAVFESLDRAHTGFLTAREFCLGLGMFVGVASAQGANPCRTPEETFESGGLDVQGTAGSLDEEEEEEERFHTVLEQLGVAPVLGKQRAVRTLWARLQRERPELLGSFEDVLIRASACLEEAARERDGLEQALRRRESEHEREVRALYEETEQLREQSRRPPSQNFARGERRSRLELELQSREQDLERAGLRQRELEQQLHAQAAEHLEAQAQNSQLWRAHEALRTQLEGAQEQIRRLESEARGRQEQTQRDVVAVSRNMQKEKVSLLRQLELLRELNTRLRDDRDACEARRAGSSCRKALTTARLPGPTCCCCCCWARPPRRGSGHLPSAR

SEQ ID NO: 10863 - protein, 53 aa, Homo sapiens
  Payload ID: 2155;
  Gene Symbol: CRACR2B;
  Gene Name: calcium release activated channel regulator 2B;
  ENSP ID: ENSP00000436624
MASPGKPGADEAQEEEGELEGGSAGPRAAILEQAEELFLLCDKEAKGFITKHD

SEQ ID NO: 10864 - protein, 649 aa, Homo sapiens
  Payload ID: 2156;
  Gene Symbol: CARF;
  Gene Name: calcium responsive transcription factor;
  Uniprot ID:  Q8N187;
  ENSP ID: ENSP00000316224
MEQSNDSLRVNHNDGEESKTSAQVFEMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKTVDYKKLSAT

SEQ ID NO: 10865 - protein, 725 aa, Homo sapiens
  Payload ID: 2156;
  Gene Symbol: CARF;
  Gene Name: calcium responsive transcription factor;
  Uniprot ID:  Q8N187;
  ENSP ID: ENSP00000384006
MEQSNDSLRVNHNDGEESKTSAQVFEHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKTVDYKKLSAT

SEQ ID NO: 10866 - protein, 95 aa, Homo sapiens
  Payload ID: 2156;
  Gene Symbol: CARF;
  Gene Name: calcium responsive transcription factor;
  ENSP ID: ENSP00000387785
MEQSNDSLRVNHNDGEESKTSAQVFEHLICMDSRDSSFGQNDSPTVLPITTREANNSLISQNIPGPLTQTQTLSAEQFHLVDQNGQAIQYELQSL

SEQ ID NO: 10867 - protein, 131 aa, Homo sapiens
  Payload ID: 2156;
  Gene Symbol: CARF;
  Gene Name: calcium responsive transcription factor;
  ENSP ID: ENSP00000391617
MEQSNDSLRVNHNDGEESKTSAQVFEHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIP

SEQ ID NO: 10868 - protein, 419 aa, Homo sapiens
  Payload ID: 2156;
  Gene Symbol: CARF;
  Gene Name: calcium responsive transcription factor;
  ENSP ID: ENSP00000392274
MDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLSPSYFI

SEQ ID NO: 10869 - protein, 21 aa, Homo sapiens
  Payload ID: 2156;
  Gene Symbol: CARF;
  Gene Name: calcium responsive transcription factor;
  ENSP ID: ENSP00000394298
MEQSNDSLRVNHNDGEESKTS

SEQ ID NO: 10870 - protein, 80 aa, Homo sapiens
  Payload ID: 2156;
  Gene Symbol: CARF;
  Gene Name: calcium responsive transcription factor;
  ENSP ID: ENSP00000394990
MEQSNDSLRVNHNDGEESKTSAQVFEMIVASPTENGQVLRVIPPTQTGMAQVIIPQGQLVDVNSPRDVPEEKPSNRNLPT

SEQ ID NO: 10871 - protein, 92 aa, Homo sapiens
  Payload ID: 2156;
  Gene Symbol: CARF;
  Gene Name: calcium responsive transcription factor;
  ENSP ID: ENSP00000395276
MDSRDSSFGQNDSPTVLPITTREANNSLISQNIPGPLTQTQTLSAEQFHLVDQNGQAIQYELQSLGESNAQMMIVASPTENGQVLRVIPPTQ

SEQ ID NO: 10872 - protein, 649 aa, Homo sapiens; identical to SEQ ID NO: 10864
  Payload ID: 2156;
  Gene Symbol: CARF;
  Gene Name: calcium responsive transcription factor;
  Uniprot ID:  Q8N187;
  ENSP ID: ENSP00000396221

SEQ ID NO: 10873 - protein, 72 aa, Homo sapiens
  Payload ID: 2156;
  Gene Symbol: CARF;
  Gene Name: calcium responsive transcription factor;
  ENSP ID: ENSP00000401918
MEQSNDSLRVNHNDGEESKTSAQVFEHLICMDSRDSSFGQNDSPTVLPITTREANNSLISQNIPGPLTQTQT

SEQ ID NO: 10874 - protein, 38 aa, Homo sapiens
  Payload ID: 2156;
  Gene Symbol: CARF;
  Gene Name: calcium responsive transcription factor;
  ENSP ID: ENSP00000408998
MDSRDSSFGQNDSPTVLPITTREANNSLISQNIPGPLT

SEQ ID NO: 10875 - protein, 33 aa, Homo sapiens
  Payload ID: 2156;
  Gene Symbol: CARF;
  Gene Name: calcium responsive transcription factor;
  ENSP ID: ENSP00000409985
MEQSNDSLRVNHNDGEESKTSAQVFEGFFLWTK

SEQ ID NO: 10876 - protein, 73 aa, Homo sapiens
  Payload ID: 2156;
  Gene Symbol: CARF;
  Gene Name: calcium responsive transcription factor;
  ENSP ID: ENSP00000413166
MEQSNDSLRVNHNDGEESKTSAQVFEHLICMDSRDSSFGQNDSPTVLPITTREANNSLISQNIPGPLTQTQTL

SEQ ID NO: 10877 - protein, 54 aa, Homo sapiens
  Payload ID: 2156;
  Gene Symbol: CARF;
  Gene Name: calcium responsive transcription factor;
  ENSP ID: ENSP00000413296
MEQSNDSLRVNHNDGEESKTSAQVFEHLICMDSRDSSFGQNDSPTVLPITTREA

SEQ ID NO: 10878 - protein, 725 aa, Homo sapiens; identical to SEQ ID NO: 10865
  Payload ID: 2156;
  Gene Symbol: CARF;
  Gene Name: calcium responsive transcription factor;
  Uniprot ID:  Q8N187;
  ENSP ID: ENSP00000414644

SEQ ID NO: 10879 - protein, 189 aa, Homo sapiens
  Payload ID: 2156;
  Gene Symbol: CARF;
  Gene Name: calcium responsive transcription factor;
  ENSP ID: ENSP00000414789
MDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEGVELW

SEQ ID NO: 10880 - protein, 207 aa, Homo sapiens
  Payload ID: 2156;
  Gene Symbol: CARF;
  Gene Name: calcium responsive transcription factor;
  Uniprot ID:  Q8N187;
  ENSP ID: ENSP00000415948
MIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGTFLKNYFKRFSSSHSPLSKCDFPKVITFLFW

SEQ ID NO: 10881 - protein, 623 aa, Homo sapiens
  Payload ID: 2156;
  Gene Symbol: CARF;
  Gene Name: calcium responsive transcription factor;
  ENSP ID: ENSP00000416160
MIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKTVDYKKLSAT

SEQ ID NO: 10882 - protein, 309 aa, Homo sapiens
  Payload ID: 2156;
  Gene Symbol: CARF;
  Gene Name: calcium responsive transcription factor;
  ENSP ID: ENSP00000416812
MEQSNDSLRVNHNDGEESKTSAQVFEHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGTFLKNYFKRFSSSHSPLSKCDFPKVITFLFW

SEQ ID NO: 10883 - protein, 370 aa, Homo sapiens
  Payload ID: 2157;
  Gene Symbol: CAMK1;
  Gene Name: calcium/calmodulin-dependent prt kinase I;
  Uniprot ID:  Q14012;
  ENSP ID: ENSP00000256460
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 10884 - protein, 39 aa, Homo sapiens
  Payload ID: 2157;
  Gene Symbol: CAMK1;
  Gene Name: calcium/calmodulin-dependent prt kinase I;
  ENSP ID: ENSP00000380447
MLGAVEGPRWKQAEDIRDIYDFRDVLGTLSPGGGKDDRH

SEQ ID NO: 10885 - protein, 260 aa, Homo sapiens
  Payload ID: 2157;
  Gene Symbol: CAMK1;
  Gene Name: calcium/calmodulin-dependent prt kinase I;
  ENSP ID: ENSP00000393238
  MOD_RES (1)..(1): Any amino acid
XDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGEERALQKGMGGPQRCTRAGVEGLPLRPPLFCLPMQGRQLAVAVETAAWSRAQNCPPHCPTSSRALDLGS

SEQ ID NO: 10886 - protein, 122 aa, Homo sapiens
  Payload ID: 2157;
  Gene Symbol: CAMK1;
  Gene Name: calcium/calmodulin-dependent prt kinase I;
  ENSP ID: ENSP00000404587
MLGAVEGPRWKQAEDIRDIYDFRDVLGTIKHPNIVALDDIYESGGHLYLIMQLVSGGELFDRIVEKGFYTERDASRLIFQVLDAVKYLHDLGIVHRDLKPENLLYYSLDEDSKIMISDFGLS

SEQ ID NO: 10887 - protein, 357 aa, Homo sapiens
  Payload ID: 2158;
  Gene Symbol: CAMK1D;
  Gene Name: calcium/calmodulin-dependent prt kinase ID;
  Uniprot ID:  Q8IU85;
  ENSP ID: ENSP00000368122
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCAYVAKPESLS

SEQ ID NO: 10888 - protein, 291 aa, Homo sapiens [sequence omitted]

SEQ ID NO: 10889 - protein, 385 aa, Homo sapiens
  Payload ID: 2158;
  Gene Symbol: CAMK1D;
  Gene Name: calcium/calmodulin-dependent prt kinase ID;
  Uniprot ID:  Q8IU85;
  ENSP ID: ENSP00000478874
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 10890 - protein, 476 aa, Homo sapiens [sequence omitted]

SEQ ID NO: 10891 - protein, 476 aa, Homo sapiens [sequence omitted]

SEQ ID NO: 10892 - protein, 245 aa, Homo sapiens
  Payload ID: 2159;
  Gene Symbol: CAMK1G;
  Gene Name: calcium/calmodulin-dependent prt kinase IG;
  ENSP ID: ENSP00000392173
MGRKEEDDCSSWKKQTTNIRKTFIFMEVLGSGAFSEVFLVKQRLTGKLFALKCIKKSPAFRDSSLENEIAVLKKIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGIMSTACGTPGYVGSVDTPHSMKKRSLSFSRRSRRATMSLSLHSGMTFLSQPRTLFATCLRRIRTSGTPVRR

SEQ ID NO: 10893 - protein, 478 aa, Homo sapiens
  Payload ID: 2160;
  Gene Symbol: CAMK2A;
  Gene Name: calcium/calmodulin-dependent prt kinase II alpha;
  Uniprot ID:  Q9UQM7;
  ENSP ID: ENSP00000261793
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 10894 - protein, 489 aa, Homo sapiens
  Payload ID: 2160;
  Gene Symbol: CAMK2A;
  Gene Name: calcium/calmodulin-dependent prt kinase II alpha;
  Uniprot ID:  Q9UQM7;
  ENSP ID: ENSP00000381412
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 10895 - protein, 90 aa, Homo sapiens
  Payload ID: 2160;
  Gene Symbol: CAMK2A;
  Gene Name: calcium/calmodulin-dependent prt kinase II alpha;
  ENSP ID: ENSP00000426607
MATITCTRFTEEYQLFEELGKGAFSVVRRCVKVLAGQEYAAKIINTKKLSARDHQKLEREARICRLLKHPNIVRLHDSISEEGHHYLIFD

SEQ ID NO: 10896 - protein, 24 aa, Homo sapiens
  Payload ID: 2160;
  Gene Symbol: CAMK2A;
  Gene Name: calcium/calmodulin-dependent prt kinase II alpha;
  ENSP ID: ENSP00000427580
MGVVHRDLKPENLLLASKLKGAAV

SEQ ID NO: 10897 - protein, 517 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000258682
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10898 - protein, 542 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000326375
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10899 - protein, 479 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000326427
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10900 - protein, 449 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000326518
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10901 - protein, 492 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000326544
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKEPQTTVIHNPVDGIKESSDSANTTIEDEDAKARKQEIIKTTEQLIEAVNNGDFEAYAFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10902 - protein, 362 aa, Homo sapiens
  Payload ID: 2161;
  Gene Symbol: CAMK2B;
  Gene Name: calcium/calmodulin-dependent prt kinase II beta;
  ENSP ID: ENSP00000326600
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKPRVYSTRKQMESSPRRIAPKTVQPPPAPKGRFLLPPWSLKPPSSITQWTGLRSLLTVPIPP

SEQ ID NO: 10903 - protein, 503 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000351542
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10904 - protein, 518 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000379096
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10905 - protein, 666 aa, Homo sapiens
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000379098
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10906 - protein, 180 aa, Homo sapiens
  Payload ID: 2161;
  Gene Symbol: CAMK2B;
  Gene Name: calcium/calmodulin-dependent prt kinase II beta;
  ENSP ID: ENSP00000388445
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKLHGELGASTHSRWQNHHVQWPVDWCSVDTDACAPAGWDPQGD

SEQ ID NO: 10907 - protein, 184 aa, Homo sapiens
  Payload ID: 2161;
  Gene Symbol: CAMK2B;
  Gene Name: calcium/calmodulin-dependent prt kinase II beta;
  ENSP ID: ENSP00000388951
  MOD_RES (1)..(1): Any amino acid
XAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKGMDDIPGLLPPPPVGRHQT

SEQ ID NO: 10908 - protein, 518 aa, Homo sapiens; identical to SEQ ID NO: 10904
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000390292

SEQ ID NO: 10909 - protein, 173 aa, Homo sapiens
  Payload ID: 2161;
  Gene Symbol: CAMK2B;
  Gene Name: calcium/calmodulin-dependent prt kinase II beta;
  ENSP ID: ENSP00000390419
MRIPEWVAGSPVFTPQMHRSTPVCPLGLQRCPGHWRGRGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLAD

SEQ ID NO: 10910 - protein, 542 aa, Homo sapiens; identical to SEQ ID NO: 10898
  Payload ID: 2161;
  Gene Symbol: CAMK2B;
  Gene Name: calcium/calmodulin-dependent prt kinase II beta;
  Uniprot ID:  Q13554;
  ENSP ID: ENSP00000397937

SEQ ID NO: 10911 - protein, 168 aa, Homo sapiens
  Payload ID: 2161;
  Gene Symbol: CAMK2B;
  Gene Name: calcium/calmodulin-dependent prt kinase II beta;
  ENSP ID: ENSP00000400387
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADARATRTNPPAVCHSHCIQQILEAVLHCHQMGVVHRDLKPENLLLASKCKGAAVKLA

SEQ ID NO: 10912 - protein, 184 aa, Homo sapiens
  Payload ID: 2161;
  Gene Symbol: CAMK2B;
  Gene Name: calcium/calmodulin-dependent prt kinase II beta;
  ENSP ID: ENSP00000410445
LPAVSLTGMDDIPGLLPPPPVGRHQTGGGVEILLEKRLLGHGLGMAGQWLARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 10913 - protein, 112 aa, Homo sapiens
  Payload ID: 2161;
  Gene Symbol: CAMK2B;
  Gene Name: calcium/calmodulin-dependent prt kinase II beta;
  ENSP ID: ENSP00000428912
MATTVTCTRFTDEYQLYEDIGKGAFSVVRRCVKLCTGHEYAAKIINTKKLSARDHQKLEREARICRLLKHSNIVTVSSRSWRPFSIVTKWGSSTETSSRRTCFWPASAKGLQ

SEQ ID NO: 10914 - protein, 478 aa, Homo sapiens
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000296402
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 10915 - protein, 499 aa, Homo sapiens
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000339740
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 10916 - protein, 478 aa, Homo sapiens; identical to SEQ ID NO: 10914
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000369098

SEQ ID NO: 10917 - protein, 492 aa, Homo sapiens
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000378030
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 10918 - protein, 478 aa, Homo sapiens
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000378032
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 10919 - protein, 489 aa, Homo sapiens
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000422566
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 10920 - protein, 510 aa, Homo sapiens
  Payload ID: 2162;
  Gene Symbol: CAMK2D;
  Gene Name: calcium/calmodulin-dependent prt kinase II delta;
  Uniprot ID:  Q13557;
  ENSP ID: ENSP00000423482
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKKRKSSSSVQMMESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 10921 - protein, 498 aa, Homo sapiens
  Payload ID: 2162;
  Gene Symbol: CAMK2D;
  Gene Name: calcium/calmodulin-dependent prt kinase II delta;
  ENSP ID: ENSP00000423677
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 10922 - protein, 194 aa, Homo sapiens
  Payload ID: 2162;
  Gene Symbol: CAMK2D;
  Gene Name: calcium/calmodulin-dependent prt kinase II delta;
  ENSP ID: ENSP00000423753
ILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAKSLLKKPDGVKSTESSNTTIEDEDVKARKQEIIKVTEQLIEAINNGDFEAYTKICDPGLTAFEPEALGNLVEGMDFHRFYFEN

SEQ ID NO: 10923 - protein, 512 aa, Homo sapiens
  Payload ID: 2162;
  Gene Symbol: CAMK2D;
  Gene Name: calcium/calmodulin-dependent prt kinase II delta;
  ENSP ID: ENSP00000424245
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILEAVLHCHQMGVVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 10924 - protein, 182 aa, Homo sapiens
  Payload ID: 2162;
  Gene Symbol: CAMK2D;
  Gene Name: calcium/calmodulin-dependent prt kinase II delta;
  ENSP ID: ENSP00000424247
  MOD_RES (1)..(1): Any amino acid
XRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 10925 - protein, 533 aa, Homo sapiens
  Payload ID: 2162;
  Gene Symbol: CAMK2D;
  Gene Name: calcium/calmodulin-dependent prt kinase II delta;
  ENSP ID: ENSP00000425824
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILEAVLHCHQMGVVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 10926 - protein, 495 aa, Homo sapiens
  Payload ID: 2163;
  Gene Symbol: CAMK2G;
  Gene Name: calcium/calmodulin-dependent prt kinase II gamma;
  Uniprot ID:  Q13555;
  ENSP ID: ENSP00000277853
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10927 - protein, 529 aa, Homo sapiens
  Payload ID: 2163;
  Gene Symbol: CAMK2G;
  Gene Name: calcium/calmodulin-dependent prt kinase II gamma;
  Uniprot ID:  Q13555;
  ENSP ID: ENSP00000307082
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10928 - protein, 527 aa, Homo sapiens
  Payload ID: 2163;
  Gene Symbol: CAMK2G;
  Gene Name: calcium/calmodulin-dependent prt kinase II gamma;
  Uniprot ID:  Q13555;
  ENSP ID: ENSP00000315599
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10929 - protein, 556 aa, Homo sapiens
  Payload ID: 2163;
  Gene Symbol: CAMK2G;
  Gene Name: calcium/calmodulin-dependent prt kinase II gamma;
  Uniprot ID:  Q13555;
  ENSP ID: ENSP00000319060
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10930 - protein, 516 aa, Homo sapiens
  Payload ID: 2163;
  Gene Symbol: CAMK2G;
  Gene Name: calcium/calmodulin-dependent prt kinase II gamma;
  ENSP ID: ENSP00000361851
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10931 - protein, 539 aa, Homo sapiens
  Payload ID: 2163;
  Gene Symbol: CAMK2G;
  Gene Name: calcium/calmodulin-dependent prt kinase II gamma;
  ENSP ID: ENSP00000378243
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10932 - protein, 453 aa, Homo sapiens
  Payload ID: 2163;
  Gene Symbol: CAMK2G;
  Gene Name: calcium/calmodulin-dependent prt kinase II gamma;
  ENSP ID: ENSP00000393784
RLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10933 - protein, 335 aa, Homo sapiens
  Payload ID: 2163;
  Gene Symbol: CAMK2G;
  Gene Name: calcium/calmodulin-dependent prt kinase II gamma;
  ENSP ID: ENSP00000405561
  MOD_RES (1)..(1): Any amino acid
XYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10934 - protein, 558 aa, Homo sapiens
  Payload ID: 2163;
  Gene Symbol: CAMK2G;
  Gene Name: calcium/calmodulin-dependent prt kinase II gamma;
  ENSP ID: ENSP00000410298
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKGRVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 10935 - protein, 78 aa, Homo sapiens
  Payload ID: 2164;
  Gene Symbol: CAMK2N1;
  Gene Name: calcium/calmodulin-dependent prt kinase II inhibitor 1;
  Uniprot ID:  Q7Z7J9;
  ENSP ID: ENSP00000364219
MSEVLPYGDEKLSPYGDGGDVGQIFSCRLQDTNNFFGAGQNKRPPKLGQIGRSKRVVIEDDRIDDVLKNMTDKAPPGV

SEQ ID NO: 10936 - protein, 79 aa, Homo sapiens
  Payload ID: 2165;
  Gene Symbol: CAMK2N2;
  Gene Name: calcium/calmodulin-dependent prt kinase II inhibitor 2;
  Uniprot ID:  Q96S95;
  ENSP ID: ENSP00000296238
MSEILPYSEDKMGRFGADPEGSDLSFSCRLQDTNSFFAGNQAKRPPKLGQIGRAKRVVIEDDRIDDVLKGMGEKPPSGV

SEQ ID NO: 10937 - protein, 473 aa, Homo sapiens
  Payload ID: 2166;
  Gene Symbol: CAMK4;
  Gene Name: calcium/calmodulin-dependent prt kinase IV;
  Uniprot ID:  Q16566;
  ENSP ID: ENSP00000282356
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 10938 - protein, 109 aa, Homo sapiens
  Payload ID: 2166;
  Gene Symbol: CAMK4;
  Gene Name: calcium/calmodulin-dependent prt kinase IV;
  ENSP ID: ENSP00000421606
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIDCGKGILQ

SEQ ID NO: 10939 - protein, 473 aa, Homo sapiens; identical to SEQ ID NO: 10937
  Payload ID: 2166;
  Gene Symbol: CAMK4;
  Gene Name: calcium/calmodulin-dependent prt kinase IV;
  Uniprot ID:  Q16566;
  ENSP ID: ENSP00000422634

SEQ ID NO: 10940 - protein, 88 aa, Homo sapiens
  Payload ID: 2166;
  Gene Symbol: CAMK4;
  Gene Name: calcium/calmodulin-dependent prt kinase IV;
  ENSP ID: ENSP00000423761
MLKVTVPSCSASSCSSVTASAAPGTASLVPDYWIDGSNRDALSDFFEVESELGRGATSIVYRCKQKGTQKPYALKVLKKTDCGKGILQ

SEQ ID NO: 10941 - protein, 88 aa, Homo sapiens; identical to SEQ ID NO: 10940
  Payload ID: 2166;
  Gene Symbol: CAMK4;
  Gene Name: calcium/calmodulin-dependent prt kinase IV;
  ENSP ID: ENSP00000424912

SEQ ID NO: 10942 - protein, 142 aa, Homo sapiens
  Payload ID: 2166;
  Gene Symbol: CAMK4;
  Gene Name: calcium/calmodulin-dependent prt kinase IV;
  ENSP ID: ENSP00000426940
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAA

SEQ ID NO: 10943 - protein, 520 aa, Homo sapiens
  Payload ID: 2167;
  Gene Symbol: CAMKK1;
  Gene Name: calcium/calmodulin-dependent prt kinase kinase 1, alpha;
  Uniprot ID:  Q8N5S9;
  ENSP ID: ENSP00000158166
MEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLALQNQAQNIQLDSTNIAKPHSLLPSEQQDSGSTWAARSVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLV

SEQ ID NO: 10944 - protein, 505 aa, Homo sapiens
  Payload ID: 2167;
  Gene Symbol: CAMKK1;
  Gene Name: calcium/calmodulin-dependent prt kinase kinase 1, alpha;
  Uniprot ID:  Q8N5S9;
  ENSP ID: ENSP00000323118
MEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 10945 - protein, 532 aa, Homo sapiens
  Payload ID: 2167;
  Gene Symbol: CAMKK1;
  Gene Name: calcium/calmodulin-dependent prt kinase kinase 1, alpha;
  ENSP ID: ENSP00000371188
MQFGKLWCGCSGEFPTRLRRRTPLTEAMEGGPAVCCQDPRAELVERVAAIDVTHLEEADGGPEPTRNGVDPPPRARAASVIPGSTSRLLPARPSLSARKLSLQERPAGSYLEAQAGPYATGPASHISPRAWRRPTIESHHVAISDAEDCVQLNQYKLQSEIGKGAYGVVRLAYNESEDRHYAMKVLSKKKLLKQYGFPRRPPPRGSQAAQGGPAKQLLPLERVYQEIAILKKLDHVNVVKLIEVLDDPAEDNLYLVFDLLRKGPVMEVPCDKPFSEEQARLYLRDVILGLEYLHCQKIVHRDIKPSNLLLGDDGHVKIADFGVSNQFEGNDAQLSSTAGTPAFMAPEAISDSGQSFSGKALDVWATGVTLYCFVYGKCPFIDDFILALHRKIKNEPVVFPEEPEISEELKDLILKMLDKNPETRIGVPDIKLHPWVTKNGEEPLPSEEEHCSVVEVTEEEVKNSVRLIPSWTTVILVKSMLRKRSFGNPFEPQARREERSMSAPGNLLVKEGFGEGGKSPELPGVQEDEAAS

SEQ ID NO: 10946 - protein, 588 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000312741
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 10947 - protein, 545 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000321230
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 10948 - protein, 541 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000336634
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKQGSEDNLQGTDPPPVGEEEVLL

SEQ ID NO: 10949 - protein, 533 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000376265
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKT

SEQ ID NO: 10950 - protein, 556 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000376266
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKGTKKKKGLDSMTSTVAAGWLDRRV

SEQ ID NO: 10951 - protein, 588 aa, Homo sapiens; identical to SEQ ID NO: 10946
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000384591

SEQ ID NO: 10952 - protein, 588 aa, Homo sapiens; identical to SEQ ID NO: 10946
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000384600

SEQ ID NO: 10953 - protein, 490 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000388273
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKKPTRECESLSELKT

SEQ ID NO: 10954 - protein, 541 aa, Homo sapiens; identical to SEQ ID NO: 10948
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000388368

SEQ ID NO: 10955 - protein, 343 aa, Homo sapiens
  Payload ID: 2168;
  Gene Symbol: CAMKK2;
  Gene Name: calcium/calmodulin-dependent prt kinase kinase 2, beta;
  ENSP ID: ENSP00000441352
MQPSCWQTQPRGCCLLPAHIYSLFFSPAIRLLPIPCGCAKVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKGTKKKKGLDSMTSTVAAGWLDRRV

SEQ ID NO: 10956 - protein, 125 aa, Homo sapiens
  Payload ID: 2168;
  Gene Symbol: CAMKK2;
  Gene Name: calcium/calmodulin-dependent prt kinase kinase 2, beta;
  ENSP ID: ENSP00000444894
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPS

SEQ ID NO: 10957 - protein, 87 aa, Homo sapiens
  Payload ID: 2168;
  Gene Symbol: CAMKK2;
  Gene Name: calcium/calmodulin-dependent prt kinase kinase 2, beta;
  ENSP ID: ENSP00000445400
MSSCVSSQPSSNRAAPQDELGGRGSSSSESQKPCEALRGLSSLSIHLGMESFIVVTECEPGCAVDLGLARDRPLEADGQEVPLDTSG

SEQ ID NO: 10958 - protein, 498 aa, Homo sapiens
  Payload ID: 2168;
  Gene Symbol: CAMKK2;
  Gene Name: calcium/calmodulin-dependent prt kinase kinase 2, beta;
  Uniprot ID:  Q96RR4;
  ENSP ID: ENSP00000445944
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 10959 - protein, 590 aa, Homo sapiens
  Payload ID: 2169;
  Gene Symbol: CASK;
  Gene Name: calcium/calmodulin-dependent serine prt kinase (MAGUK family);
  ENSP ID: ENSP00000367396
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEVMTLTNHPHLL

SEQ ID NO: 10960 - protein, 909 aa, Homo sapiens
  Payload ID: 2169;
  Gene Symbol: CASK;
  Gene Name: calcium/calmodulin-dependent serine prt kinase (MAGUK family);
  Uniprot ID:  O14936;
  ENSP ID: ENSP00000367400
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10961 - protein, 926 aa, Homo sapiens
  Payload ID: 2169;
  Gene Symbol: CASK;
  Gene Name: calcium/calmodulin-dependent serine prt kinase (MAGUK family);
  Uniprot ID:  O14936;
  ENSP ID: ENSP00000367405
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10962 - protein, 921 aa, Homo sapiens
  Payload ID: 2169;
  Gene Symbol: CASK;
  Gene Name: calcium/calmodulin-dependent serine prt kinase (MAGUK family);
  Uniprot ID:  O14936;
  ENSP ID: ENSP00000367408
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10963 - protein, 381 aa, Homo sapiens
  Payload ID: 2169;
  Gene Symbol: CASK;
  Gene Name: calcium/calmodulin-dependent serine prt kinase (MAGUK family);
  ENSP ID: ENSP00000367410
DEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10964 - protein, 518 aa, Homo sapiens
  Payload ID: 2169;
  Gene Symbol: CASK;
  Gene Name: calcium/calmodulin-dependent serine prt kinase (MAGUK family);
  ENSP ID: ENSP00000367421
LYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10965 - protein, 898 aa, Homo sapiens
  Payload ID: 2169;
  Gene Symbol: CASK;
  Gene Name: calcium/calmodulin-dependent serine prt kinase (MAGUK family);
  Uniprot ID:  O14936;
  ENSP ID: ENSP00000398007
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10966 - protein, 897 aa, Homo sapiens
  Payload ID: 2169;
  Gene Symbol: CASK;
  Gene Name: calcium/calmodulin-dependent serine prt kinase (MAGUK family);
  Uniprot ID:  O14936;
  ENSP ID: ENSP00000400526
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCEDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 10967 - protein, 395 aa, Homo sapiens
  Payload ID: 2170;
  Gene Symbol: CABS1;
  Gene Name: calcium-binding prt, spermatid-specific 1;
  Uniprot ID:  Q96KC9;
  ENSP ID: ENSP00000273936
MAEDGLPKIYSHPPTESSKTPTAATIFFGADNAIPKSETTITSEGDHVTSVNEYMLESDFSTTTDNKLTAKKEKLKSEDDMGTDFIKSTTHLQKEITSLTGTTNSITRDSITEHFMPVKIGNISSPVTTVSLIDFSTDIAKEDILLATIDTGDAEISITSEVSGTLKDSSAGVADAPAFPRKKDEADMSNYNSSIKSNVPADEAVQVTDSTIPEAEIPPAPEESFTTIPDITALEEEKITEIDLSVLEDDTSAVATLTDSDEKFITVFELTTSAEKDKDKREDTLLTDEETTEGASIWMERDTANEAETHSVLLTAVESRYDFVVPASIATNLVEESSTEEDLSETDNTETVPKITEPFSGTTSVLDTPDYKEDTSTTETDIFELLKEEPDEFMI

SEQ ID NO: 10968 - protein, 1078 aa, Homo sapiens
  Payload ID: 2171;
  Gene Symbol: CASR;
  Gene Name: calcium-sensing receptor;
  Uniprot ID:  P41180;
  ENSP ID: ENSP00000418685
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHEPLLPLQCGETDLDLTVQETGLQGPVGGDQRPEVEDPEELSPALVVSSSQSFVISGGGSTVTENVVNS

SEQ ID NO: 10969 - protein, 1088 aa, Homo sapiens
  Payload ID: 2171;
  Gene Symbol: CASR;
  Gene Name: calcium-sensing receptor;
  ENSP ID: ENSP00000420194
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREPLTFVLSVLQVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHEPLLPLQCGETDLDLTVQETGLQGPVGGDQRPEVEDPEELSPALVVSSSQSFVISGGGSTVTENVVNS

SEQ ID NO: 10970 - protein, 228 aa, Homo sapiens
  Payload ID: 2172;
  Gene Symbol: CACYBP;
  Gene Name: calcyclin binding prt;
  Uniprot ID:  Q9HB71;
  ENSP ID: ENSP00000356652
MASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 10971 - protein, 80 aa, Homo sapiens
  Payload ID: 2172;
  Gene Symbol: CACYBP;
  Gene Name: calcyclin binding prt;
  Uniprot ID:  Q9HB71;
  ENSP ID: ENSP00000384139
MASEELQKDLEEVKVLLEKATRKRVRDALTAEKSKIETEIKNKMQQKSQKKAELLDNEKPAAVVAPITTGYTDGISQISL

SEQ ID NO: 10972 - protein, 185 aa, Homo sapiens
  Payload ID: 2172;
  Gene Symbol: CACYBP;
  Gene Name: calcyclin binding prt;
  Uniprot ID:  Q9HB71;
  ENSP ID: ENSP00000385771
MQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 10973 - protein, 50 aa, Homo sapiens
  Payload ID: 2172;
  Gene Symbol: CACYBP;
  Gene Name: calcyclin binding prt;
  ENSP ID: ENSP00000403674
MASEELQKDLEEVKVLLEKATRKRVRDALTAEKSKIETEIKNKMQQKSQK

SEQ ID NO: 10974 - protein, 185 aa, Homo sapiens; identical to SEQ ID NO: 10972
  Payload ID: 2172;
  Gene Symbol: CACYBP;
  Gene Name: calcyclin binding prt;
  Uniprot ID:  Q9HB71;
  ENSP ID: ENSP00000479414

SEQ ID NO: 10975 - protein, 217 aa, Homo sapiens
  Payload ID: 2173;
  Gene Symbol: CALY;
  Gene Name: calcyon neuron-specific vesicular prt;
  Uniprot ID:  Q9NYX4;
  ENSP ID: ENSP00000252939
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 10976 - protein, 158 aa, Homo sapiens
  Payload ID: 2173;
  Gene Symbol: CALY;
  Gene Name: calcyon neuron-specific vesicular prt;
  Uniprot ID:  Q9NYX4;
  ENSP ID: ENSP00000357543
MVKLGCSFSGKPGKDPGDQDGAAMDSVPLISPLDISQLQPPLPDQVVIKTQTEYQLSSPDQQNFPDLEGQRLNCSHPEEGRRVTTPTPPTVGTQDRRRRWKAAGGAWVPSRPVWGPLALREERVAVSHPAQSWPHRLPCTHQAPSRGCRCRLTKQWRS

SEQ ID NO: 10977 - protein, 124 aa, Homo sapiens
  Payload ID: 2173;
  Gene Symbol: CALY;
  Gene Name: calcyon neuron-specific vesicular prt;
  Uniprot ID:  Q9NYX4;
  ENSP ID: ENSP00000357546
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRGPEF

SEQ ID NO: 10978 - protein, 162 aa, Homo sapiens
  Payload ID: 2174;
  Gene Symbol: CAPS;
  Gene Name: calcyphosine;
  Uniprot ID:  Q13938;
  ENSP ID: ENSP00000222125
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVTLAEFQDYYSGVSASMNTDEEFVAMMTSAWQL

SEQ ID NO: 10979 - protein, 248 aa, Homo sapiens
  Payload ID: 2174;
  Gene Symbol: CAPS;
  Gene Name: calcyphosine;
  Uniprot ID:  Q13938;
  ENSP ID: ENSP00000403263
MQCHRDLALSQALWGWQLSKQSGWAHPSLPHSPLPSTVHSCSWAPPHLQRHLPLATVSPGTTQLTQGPAGRTLGQTQASCPEPRPSMDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVTLAEFQDYYSGVSASMNTDEEFVAMMTSAWQL

SEQ ID NO: 10980 - protein, 275 aa, Homo sapiens
  Payload ID: 2174;
  Gene Symbol: CAPS;
  Gene Name: calcyphosine;
  ENSP ID: ENSP00000465883
MQCHRDLALSQALWGWQLSKQSGWAHPSLPHSPLPSTVHSCSWAPPHLQRHLPLATVSPGTTQLTQGPAGRTLGQTQASCPEPRPSMDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGEWTEDEVLRRFLDNFDSSEKDGQVTLAEFQDYYSGVSASMNTDEEFVAMMTSAWQL

SEQ ID NO: 10981 - protein, 134 aa, Homo sapiens
  Payload ID: 2174;
  Gene Symbol: CAPS;
  Gene Name: calcyphosine;
  ENSP ID: ENSP00000468582
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGE

SEQ ID NO: 10982 - protein, 189 aa, Homo sapiens
  Payload ID: 2174;
  Gene Symbol: CAPS;
  Gene Name: calcyphosine;
  Uniprot ID:  Q13938;
  ENSP ID: ENSP00000484912
MDAVDATMEKLRAQCLSRGASGIQGLARFFRQLDRDGSRSLDADEFRQGLAKLGLVLDQAEAEGVCRKWDRNGSGTLDLEEFLRALRPPMSQAREAVIAAAFAKLDRSGDGVVTVDDLRGVYSGRAHPKVRSGEWTEDEVLRRFLDNFDSSEKDGQVTLAEFQDYYSGVSASMNTDEEFVAMMTSAWQL

SEQ ID NO: 10983 - protein, 41 aa, Homo sapiens
  Payload ID: 2175;
  Gene Symbol: CAPS2;
  Gene Name: calcyphosine 2;
  ENSP ID: ENSP00000331007
MSDKLKKDLCYHNSDSPEYQDSSFSLIVAFTDAKYCSWVCL

SEQ ID NO: 10984 - protein, 142 aa, Homo sapiens
  Payload ID: 2175;
  Gene Symbol: CAPS2;
  Gene Name: calcyphosine 2;
  ENSP ID: ENSP00000338474
MSDKLKKDLCYDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAVSCQHFYLFGNCGCREEETDCCRASDDRPLI

SEQ ID NO: 10985 - protein, 382 aa, Homo sapiens
  Payload ID: 2175;
  Gene Symbol: CAPS2;
  Gene Name: calcyphosine 2;
  Uniprot ID:  Q9BXY5;
  ENSP ID: ENSP00000376963
MIDHLSRAVISDPEQNLAIEQKESDHILPDSKMTPLRFRKRTLHETKIRTHSTLTENVLSHKLQFDGRIVSRNGRDACRELIGFFFTHDQSLTIYEYRQFGKNRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISGHSTEEEIKSSFLETLKVACSKSDEVSYGEFEDYYEGLSIGIVDDEDFVNILRTPWGI

SEQ ID NO: 10986 - protein, 557 aa, Homo sapiens
  Payload ID: 2175;
  Gene Symbol: CAPS2;
  Gene Name: calcyphosine 2;
  Uniprot ID:  Q9BXY5;
  ENSP ID: ENSP00000386959
MGNSFCYTAVYCMINTGTQMDLEVKGVAATSRSQIQPFFGRKKPLQQRWTSESWTNQNSCPPVVPRLDLGSLVDSDDEDNFSYIPLSTANLPNSSSTLGWVTPCQTPYTQYHLNKLDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAEIVAAEKKKQIVAEQVMIDHLSRAVISDPEQNLAIEQKESDHILPDSKMTPLRFRKRTLHETKIRTHSTLTENVLSHKLQFDGRIVSRNGRDACRELIGFFFTHDQSLTIYEYRQFGKNRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISG

SEQ ID NO: 10987 - protein, 475 aa, Homo sapiens
  Payload ID: 2175;
  Gene Symbol: CAPS2;
  Gene Name: calcyphosine 2;
  ENSP ID: ENSP00000386977
MINTGTQMDLEVKGVAATSRSQIQPFFGRKKPLQQRWTSESWTNQNSCPPVVPRLDLGSLVDSDDEDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAEIVAAEKKKQIVAEQVMIDHLSRAVISDPEQNLAIEQKESDHILPDSKMTPLRFRKRTLHETKIRTHSTLTENVLSHKLQFDGRIVSRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISG

SEQ ID NO: 10988 - protein, 135 aa, Homo sapiens
  Payload ID: 2175;
  Gene Symbol: CAPS2;
  Gene Name: calcyphosine 2;
  ENSP ID: ENSP00000411797
MDKPEFLPTSDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAEIVAAEKKKQIVAEQVMIDHLSRAV

SEQ ID NO: 10989 - protein, 33 aa, Homo sapiens
  Payload ID: 2175;
  Gene Symbol: CAPS2;
  Gene Name: calcyphosine 2;
  ENSP ID: ENSP00000447737
MIDHLSRAVISDPEQNLAIEQKESDHILPDSKM

SEQ ID NO: 10990 - protein, 187 aa, Homo sapiens
  Payload ID: 2175;
  Gene Symbol: CAPS2;
  Gene Name: calcyphosine 2;
  ENSP ID: ENSP00000449797
MSDKLKKDLCYDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAEIVAAEKKKQIVAEQVMIDHLSRAVISDPEQNLAIEQKESDHILPDSKMTPLRFRKRTLHETKIRTHSTLTENVLS

SEQ ID NO: 10991 - protein, 208 aa, Homo sapiens
  Payload ID: 2176;
  Gene Symbol: CAPSL;
  Gene Name: calcyphosine-like;
  Uniprot ID:  Q8WWF8;
  ENSP ID: ENSP00000380523
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSASIDTDVYFIIMMRTAWKL

SEQ ID NO: 10992 - protein, 208 aa, Homo sapiens; identical to SEQ ID NO: 10991
  Payload ID: 2176;
  Gene Symbol: CAPSL;
  Gene Name: calcyphosine-like;
  Uniprot ID:  Q8WWF8;
  ENSP ID: ENSP00000380524

SEQ ID NO: 10993 - protein, 180 aa, Homo sapiens
  Payload ID: 2176;
  Gene Symbol: CAPSL;
  Gene Name: calcyphosine-like;
  ENSP ID: ENSP00000421018
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVSKRA

SEQ ID NO: 10994 - protein, 190 aa, Homo sapiens
  Payload ID: 2176;
  Gene Symbol: CAPSL;
  Gene Name: calcyphosine-like;
  ENSP ID: ENSP00000424806
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSA

SEQ ID NO: 10995 - protein, 538 aa, Homo sapiens
  Payload ID: 2177;
  Gene Symbol: CALD1;
  Gene Name: caldesmon 1;
  Uniprot ID:  Q05682;
  ENSP ID: ENSP00000354513
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 10996 - protein, 793 aa, Homo sapiens
  Payload ID: 2177;
  Gene Symbol: CALD1;
  Gene Name: caldesmon 1;
  Uniprot ID:  Q05682;
  ENSP ID: ENSP00000354826
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQVEVMVEEKTTESQEETVVMSLKNGQISSEEPKQEEEREQGSDEISHHEKMEEEDKERAEAERARLEAEERERIKAEQDKKIADERARIEAEEKAAAQERERREAEERERMREEEKRAAEERQRIKEEEKRAAEERQRIKEEEKRAAEERQRIKEEEKRAAEERQRARAEEEEKAKVEEQKRNKQLEEKKHAMQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 10997 - protein, 558 aa, Homo sapiens
  Payload ID: 2177;
  Gene Symbol: CALD1;
  Gene Name: caldesmon 1;
  Uniprot ID:  Q05682;
  ENSP ID: ENSP00000376826
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 10998 - protein, 132 aa, Homo sapiens
  Payload ID: 2177;
  Gene Symbol: CALD1;
  Gene Name: caldesmon 1;
  ENSP ID: ENSP00000390926
MDDFERRRELRRQKREEMRLEAESVYTNNSCNMLYLLKIAYQRNDDDEEEAARERRRRARQERLRQKQEEESLGQVTDQVEVNAQNSVPDEEAKTTTTNTQVEGDDEAAFLERLARREERRQKRLQEALERQ

SEQ ID NO: 10999 - protein, 532 aa, Homo sapiens
  Payload ID: 2177;
  Gene Symbol: CALD1;
  Gene Name: caldesmon 1;
  Uniprot ID:  Q05682;
  ENSP ID: ENSP00000393621
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 11000 - protein, 85 aa, Homo sapiens
  Payload ID: 2177;
  Gene Symbol: CALD1;
  Gene Name: caldesmon 1;
  ENSP ID: ENSP00000394715
MDDFERRRELRRQKREEMRLEAERIAYQRNDDDEEEAARERRRRARQERLRQKQEEESLGQVTDQQKMKLPRRKKKVKVAKKDTR

SEQ ID NO: 11001 - protein, 563 aa, Homo sapiens
  Payload ID: 2177;
  Gene Symbol: CALD1;
  Gene Name: caldesmon 1;
  Uniprot ID:  Q05682;
  ENSP ID: ENSP00000395710
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 11002 - protein, 538 aa, Homo sapiens; identical to SEQ ID NO: 10995
  Payload ID: 2177;
  Gene Symbol: CALD1;
  Gene Name: caldesmon 1;
  Uniprot ID:  Q05682;
  ENSP ID: ENSP00000398826

SEQ ID NO: 11003 - protein, 72 aa, Homo sapiens
  Payload ID: 2177;
  Gene Symbol: CALD1;
  Gene Name: caldesmon 1;
  ENSP ID: ENSP00000401988
MDDFERRRELRRQKREEMRLEAERIAYQRNDDDEEEAARERRRRARQERLRQKQEEESLGQVTDQVEVNAQN

SEQ ID NO: 11004 - protein, 536 aa, Homo sapiens
  Payload ID: 2177;
  Gene Symbol: CALD1;
  Gene Name: caldesmon 1;
  ENSP ID: ENSP00000407522
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSLTFCSSLFGLWLIGNLLLLPSFLPLLPEWVFL

SEQ ID NO: 11005 - protein, 459 aa, Homo sapiens
  Payload ID: 2177;
  Gene Symbol: CALD1;
  Gene Name: caldesmon 1;
  ENSP ID: ENSP00000411476
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKS

SEQ ID NO: 11006 - protein, 72 aa, Homo sapiens; identical to SEQ ID NO: 11003
  Payload ID: 2177;
  Gene Symbol: CALD1;
  Gene Name: caldesmon 1;
  ENSP ID: ENSP00000416611

SEQ ID NO: 11007 - protein, 557 aa, Homo sapiens
  Payload ID: 2177;
  Gene Symbol: CALD1;
  Gene Name: caldesmon 1;
  ENSP ID: ENSP00000419673
MLGGSGSHGRRSLAALSQIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 11008 - protein, 588 aa, Homo sapiens
  Payload ID: 2178;
  Gene Symbol: CCIN;
  Gene Name: calicin;
  Uniprot ID:  Q13939;
  ENSP ID: ENSP00000334996
MKLEFTEKNYNSFVLQNLNRQRKRKEYWDMALSVDNHVFFAHRNVLAAVSPLVRSLISSNDMKTADELFITIDTSYLSPVTVDQLLDYFYSGKVVISEQNVEELLRGAQYFNTPRLRVHCNDFLIKSICRANCLRYLFLAELFELKEVSDVAYSGIRDNFHYWASPEGSMHFMRCPPVIFGRLLRDENLHVLNEDQALSALINWVYFRKEDREKYFKKFFNYINLNAVSNKTLVFASNKLVGMENTSSHTTLIESVLMDRKQERPCSLLVYQRKGALLDSVVILGGQKAHGQFNDGVFAYIIQENLWMKLSDMPYRAAALSATSAGRYIYISGGTTEQISGLKTAWRYDMDDNSWTKLPDLPIGLVFHTMVTCGGTVYSVGGSIAPRRYVSNIYRYDERKEVWCLAGKMSIPMDGTAVITKGDRHLYIVTGRCLVKGYISRVGVVDCFDTSTGDVVQCITFPIEFNHRPLLSFQQDNILCVHSHRQSVEINLQKVKASKTTTSVPVLPNSCPLDVSHAICSIGDSKVFVCGGVTTASDVQTKDYTINPNAFLLDQKTGKWKTLAPPPEALDCPACCLAKLPCKILQRI

SEQ ID NO: 11009 - protein, 610 aa, Homo sapiens
  Payload ID: 2179;
  Gene Symbol: CLGN;
  Gene Name: calmegin;
  Uniprot ID:  O14967;
  ENSP ID: ENSP00000326699
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 11010 - protein, 610 aa, Homo sapiens; identical to SEQ ID NO: 11009
  Payload ID: 2179;
  Gene Symbol: CLGN;
  Gene Name: calmegin;
  Uniprot ID:  O14967;
  ENSP ID: ENSP00000392782

SEQ ID NO: 11011 - protein, 179 aa, Homo sapiens
  Payload ID: 2179;
  Gene Symbol: CLGN;
  Gene Name: calmegin;
  ENSP ID: ENSP00000424593
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIM

SEQ ID NO: 11012 - protein, 1002 aa, Homo sapiens
  Payload ID: 2180;
  Gene Symbol: CLMN;
  Gene Name: calmin (calponin-like, transmembrane);
  Uniprot ID:  Q96JQ2;
  ENSP ID: ENSP00000298912
MAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 11013 - protein, 97 aa, Homo sapiens
  Payload ID: 2180;
  Gene Symbol: CLMN;
  Gene Name: calmin (calponin-like, transmembrane);
  ENSP ID: ENSP00000451189
MAAHEWDWFQREELIGQISDIRVQNLQVERENVQKRTFTRWINLHLEKCNPPLEVKDLFVDIQDGKILMALLEVLSGRNLSPGHQLLCPWWASTGSL

SEQ ID NO: 11014 - protein, 132 aa, Homo sapiens
  Payload ID: 2180;
  Gene Symbol: CLMN;
  Gene Name: calmin (calponin-like, transmembrane);
  ENSP ID: ENSP00000451705
MALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRK

SEQ ID NO: 11015 - protein, 67 aa, Homo sapiens
  Payload ID: 2180;
  Gene Symbol: CLMN;
  Gene Name: calmin (calponin-like, transmembrane);
  ENSP ID: ENSP00000452305
MKRESKHARMSMKANSSGEAMSLGSHSPQSDSLTQLVQQPDMMYFILFLWLLVYCLLLFPQLDVSRL

SEQ ID NO: 11016 - protein, 101 aa, Homo sapiens
  Payload ID: 2180;
  Gene Symbol: CLMN;
  Gene Name: calmin (calponin-like, transmembrane);
  ENSP ID: ENSP00000452525
MALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSF

SEQ ID NO: 11017 - protein, 149 aa, Homo sapiens [sequence omitted]

SEQ ID NO: 11018 - protein, 150 aa, Homo sapiens
  Payload ID: 2181;
  Gene Symbol: CALM1;
  Gene Name: calmodulin 1 (phosphorylase kinase, delta);
  ENSP ID: ENSP00000403491
MQADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 11019 - protein, 113 aa, Homo sapiens
  Payload ID: 2181;
  Gene Symbol: CALM1;
  Gene Name: calmodulin 1 (phosphorylase kinase, delta);
  ENSP ID: ENSP00000442853
MRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 11020 - protein, 76 aa, Homo sapiens
  Payload ID: 2181;
  Gene Symbol: CALM1;
  Gene Name: calmodulin 1 (phosphorylase kinase, delta);
  ENSP ID: ENSP00000450425
MRSLGQNPTEAELQDMINEVDADGNGTIDFPEFLTMMARKMKDTDSEEEIREAFRVFDKCSRTTSRHDKLRRKTNR

SEQ ID NO: 11021 - protein, 113 aa, Homo sapiens; identical to SEQ ID NO: 11019
  Payload ID: 2181;
  Gene Symbol: CALM1;
  Gene Name: calmodulin 1 (phosphorylase kinase, delta);
  ENSP ID: ENSP00000450829

SEQ ID NO: 11022 - protein, 98 aa, Homo sapiens
  Payload ID: 2181;
  Gene Symbol: CALM1;
  Gene Name: calmodulin 1 (phosphorylase kinase, delta);
  ENSP ID: ENSP00000451062
MRSLGQNPTEAELQDMINEVDADGNGTIDFPEFLTMMARKMKDTDSEEEIREAFRVFDKDGNGYISAAELRHVMTNLGEKLTDEEVDEMIREADIDGD

SEQ ID NO: 11023 - protein, 83 aa, Homo sapiens
  Payload ID: 2181;
  Gene Symbol: CALM1;
  Gene Name: calmodulin 1 (phosphorylase kinase, delta);
  ENSP ID: ENSP00000451646
MADQLTEEQIAEFKEAFSLFDKDGDGTITTKELGTVMRSLGQNPTEAELQDMINEVDADGWQWLYQCSRTTSRHDKLRRKTNR

SEQ ID NO: 11024 - protein, 83 aa, Homo sapiens
  Payload ID: 2181;
  Gene Symbol: CALM1;
  Gene Name: calmodulin 1 (phosphorylase kinase, delta);
  ENSP ID: ENSP00000486402
MADQLTEEQIAEFKEAFSLFDKDGDGTITTKELGTVMRSLGQNPTEAELQDMINEVDEMIREADIDGDGQVNYEEFVQMMTAK

SEQ ID NO: 11025 - protein, 149 aa, Homo sapiens [sequence omitted]

SEQ ID NO: 11026 - protein, 196 aa, Homo sapiens
  Payload ID: 2182;
  Gene Symbol: CALM2;
  Gene Name: calmodulin 2 (phosphorylase kinase, delta);
  ENSP ID: ENSP00000387065
MILAHCNLCCPTSSNSPGSVSQVAGITGVHHHTRLVFVFLGEMGFHHVGQAGLELLTSEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 11027 - protein, 65 aa, Homo sapiens
  Payload ID: 2182;
  Gene Symbol: CALM2;
  Gene Name: calmodulin 2 (phosphorylase kinase, delta);
  ENSP ID: ENSP00000406112
MADQLTEEQIAEFKEAFSLFDKDGDGTITTKELGTVMRSLGQNPTEAELQDMINEVDADGWQWLY

SEQ ID NO: 11028 - protein, 187 aa, Homo sapiens
  Payload ID: 2182;
  Gene Symbol: CALM2;
  Gene Name: calmodulin 2 (phosphorylase kinase, delta);
  ENSP ID: ENSP00000411440
SPSGESELSGCVVASRKPVALAAWLALYIASHFAQQPCKADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMMTAK

SEQ ID NO: 11029 - protein, 83 aa, Homo sapiens; identical to SEQ ID NO: 11024
  Payload ID: 2182;
  Gene Symbol: CALM2;
  Gene Name: calmodulin 2 (phosphorylase kinase, delta);
  ENSP ID: ENSP00000486952

SEQ ID NO: 11030 - protein, 149 aa, Homo sapiens [sequence omitted]

SEQ ID NO: 11031 - protein, 113 aa, Homo sapiens; identical to SEQ ID NO: 11019
  Payload ID: 2183;
  Gene Symbol: CALM3;
  Gene Name: calmodulin 3 (phosphorylase kinase, delta);
  ENSP ID: ENSP00000375785

SEQ ID NO: 11032 - protein, 113 aa, Homo sapiens; identical to SEQ ID NO: 11019
  Payload ID: 2183;
  Gene Symbol: CALM3;
  Gene Name: calmodulin 3 (phosphorylase kinase, delta);
  ENSP ID: ENSP00000468877

SEQ ID NO: 11033 - protein, 83 aa, Homo sapiens; identical to SEQ ID NO: 11024
  Payload ID: 2183;
  Gene Symbol: CALM3;
  Gene Name: calmodulin 3 (phosphorylase kinase, delta);
  ENSP ID: ENSP00000470308

SEQ ID NO: 11034 - protein, 113 aa, Homo sapiens; identical to SEQ ID NO: 11019
  Payload ID: 2183;
  Gene Symbol: CALM3;
  Gene Name: calmodulin 3 (phosphorylase kinase, delta);
  ENSP ID: ENSP00000470502

SEQ ID NO: 11035 - protein, 113 aa, Homo sapiens; identical to SEQ ID NO: 11019
  Payload ID: 2183;
  Gene Symbol: CALM3;
  Gene Name: calmodulin 3 (phosphorylase kinase, delta);
  ENSP ID: ENSP00000471225

SEQ ID NO: 11036 - protein, 149 aa, Homo sapiens [sequence omitted]

SEQ ID NO: 11037 - protein, 1673 aa, Homo sapiens
  Payload ID: 2184;
  Gene Symbol: CAMTA1;
  Gene Name: calmodulin binding transcription activator 1;
  Uniprot ID:  Q9Y6Y1;
  ENSP ID: ENSP00000306522
MWRAEGKWLPKTSRKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHSPLVDHRLYKRSERIEKGQGT

SEQ ID NO: 11038 - protein, 92 aa, Homo sapiens
  Payload ID: 2184;
  Gene Symbol: CAMTA1;
  Gene Name: calmodulin binding transcription activator 1;
  ENSP ID: ENSP00000450530
MWRAEGKWLPKTSRKAQGRTDPVSVLMELRGRRTLIKMPYEISAGTQCCEDDHGNSNSSHVKIFLPKKLLECLPKCSSLPKERHRWNTNERS

SEQ ID NO: 11039 - protein, 80 aa, Homo sapiens
  Payload ID: 2184;
  Gene Symbol: CAMTA1;
  Gene Name: calmodulin binding transcription activator 1;
  Uniprot ID:  Q9Y6Y1;
  ENSP ID: ENSP00000451388
MWRAEGKWLPKTSRKSVSQSVFCGTSTYCVLNTVPPIEDDHGNSNSSHVKIFLPKKLLECLPKCSSLPKERHRWNTNERS

SEQ ID NO: 11040 - protein, 39 aa, Homo sapiens
  Payload ID: 2184;
  Gene Symbol: CAMTA1;
  Gene Name: calmodulin binding transcription activator 1;
  ENSP ID: ENSP00000451443
  MOD_RES (1)..(1): Any amino acid
XSSHVKIFLPKKLLECLPKCSSLPKERHRWNTNEVLKFW

SEQ ID NO: 11041 - protein, 101 aa, Homo sapiens
  Payload ID: 2184;
  Gene Symbol: CAMTA1;
  Gene Name: calmodulin binding transcription activator 1;
  Uniprot ID:  Q9Y6Y1;
  ENSP ID: ENSP00000451510
MWRAEGKWLPKTSRKSVSQSVFCGTSTYCVLNTVPPIEDDHGNSNSSHVKIFLPKKLLECLPKCSSLPKERHRWNTNEALTTHLFMGAAKKRDPQSWSHEG

SEQ ID NO: 11042 - protein, 637 aa, Homo sapiens
  Payload ID: 2184;
  Gene Symbol: CAMTA1;
  Gene Name: calmodulin binding transcription activator 1;
  ENSP ID: ENSP00000451720
  MOD_RES (1)..(1): Any amino acid
XMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQLTWIALKYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 11043 - protein, 239 aa, Homo sapiens
  Payload ID: 2184;
  Gene Symbol: CAMTA1;
  Gene Name: calmodulin binding transcription activator 1;
  ENSP ID: ENSP00000452024
  MOD_RES (1)..(1): Any amino acid
XSSGLERTDPATISSTMSWLASYLADADCLPSAAQIRLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 11044 - protein, 73 aa, Homo sapiens
  Payload ID: 2184;
  Gene Symbol: CAMTA1;
  Gene Name: calmodulin binding transcription activator 1;
  ENSP ID: ENSP00000452184
WLPKTSRKSVSQSVFCGTSTYCVLNTVPPIEDDHGNSNSSHVKIFLPKKLLECLPKCSSLPKERHRWNTNERS

SEQ ID NO: 11045 - protein, 237 aa, Homo sapiens
  Payload ID: 2184;
  Gene Symbol: CAMTA1;
  Gene Name: calmodulin binding transcription activator 1;
  ENSP ID: ENSP00000452319
MSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 11046 - protein, 44 aa, Homo sapiens
  Payload ID: 2184;
  Gene Symbol: CAMTA1;
  Gene Name: calmodulin binding transcription activator 1;
  ENSP ID: ENSP00000452505
  MOD_RES (1)..(1): Any amino acid
XGRTDPVSVLMELRGRRTLIKMPYEISAGTQCCEERFPKCILRN

SEQ ID NO: 11047 - protein, 1202 aa, Homo sapiens
  Payload ID: 2185;
  Gene Symbol: CAMTA2;
  Gene Name: calmodulin binding transcription activator 2;
  Uniprot ID:  O94983;
  ENSP ID: ENSP00000321813
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 11048 - protein, 1201 aa, Homo sapiens
  Payload ID: 2185;
  Gene Symbol: CAMTA2;
  Gene Name: calmodulin binding transcription activator 2;
  Uniprot ID:  O94983;
  ENSP ID: ENSP00000354828
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMENPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 11049 - protein, 1197 aa, Homo sapiens
  Payload ID: 2185;
  Gene Symbol: CAMTA2;
  Gene Name: calmodulin binding transcription activator 2;
  Uniprot ID:  O94983;
  ENSP ID: ENSP00000370712
MAAAAVTRGTPGENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 11050 - protein, 1241 aa, Homo sapiens
  Payload ID: 2185;
  Gene Symbol: CAMTA2;
  Gene Name: calmodulin binding transcription activator 2;
  Uniprot ID:  O94983;
  ENSP ID: ENSP00000412886
MGTDSPSPRPLRPGVTLPPGALTMNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMECLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKLLSHQEAGPGSPEDHEIPAALPTQDEGTEAEPGAGRASPAGTGHMTWPPPFSPPWGRLVQS

SEQ ID NO: 11051 - protein, 161 aa, Homo sapiens
  Payload ID: 2185;
  Gene Symbol: CAMTA2;
  Gene Name: calmodulin binding transcription activator 2;
  ENSP ID: ENSP00000458560
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMEGLNRGRVGEQTSPPPTPACLLAVSLWLLRSLFHRPHIPSALLLAAPEP

SEQ ID NO: 11052 - protein, 178 aa, Homo sapiens
  Payload ID: 2185;
  Gene Symbol: CAMTA2;
  Gene Name: calmodulin binding transcription activator 2;
  ENSP ID: ENSP00000459519
KDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMEQRPSRVAEVVPGGVVGTAEAHVSWHQVELREWNRRVLCRTPGAADFGHPPNQACSPNPRLSLQWGAWF

SEQ ID NO: 11053 - protein, 163 aa, Homo sapiens
  Payload ID: 2185;
  Gene Symbol: CAMTA2;
  Gene Name: calmodulin binding transcription activator 2;
  ENSP ID: ENSP00000460751
MAAAAVTRGTPGENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMEGLNRGRVGEQTSPPPTPACLLAVSLWLLRSLFHRPHIPSALLLAAPEP

SEQ ID NO: 11054 - protein, 1207 aa, Homo sapiens
  Payload ID: 2185;
  Gene Symbol: CAMTA2;
  Gene Name: calmodulin binding transcription activator 2;
  ENSP ID: ENSP00000460779
MNTKDTTEVAENSHHLKIFLPKKLLECLPRCPLLPPERLRWNTNEEIASYLITFEKHDEWLSCAPKTRPQNGSIILYNRKKVKYRKDGYLWKKRKDGKTTREDHMKLKVQGMEPVSWQCLYGCYVHSSIVPTFHRRCYWLLQNPDIVLVHYLNVPALEDCGKGCSPIFCSISSDRREWLKWSREELLGQLKPMFHGIKWSCGNGTEEFSVEHLVQQILDTHPTKPAPRTHACLCSGGLGSGSLTHKCSSTKHRIISPKVEPRALTLTSIPHAHPPEPPPLIAPLPPELPKAHTSPSSSSSSSSSGFAEPLEIRPSPPTSRGGSSRGGTAILLLTGLEQRAGGLTPTRHLAPQADPRPSMSLAVVVGTEPSAPPAPPSPAFDPDRFLNSPQRGQTYGGGQGVSPDFPEAEAAHTPCSALEPAAALEPQAAARGPPPQSVAGGRRGNCFFIQDDDSGEELKGHGAAPPIPSPPPSPPPSPAPLEPSSRVGRGEALFGGPVGASELEPFSLSSFPDLMGELISDEAPSIPAPTPQLSPALSTITDFSPEWSYPEGGVKVLITGPWTEAAEHYSCVFDHIAVPASLVQPGVLRCYCPAHEVGLVSLQVAGREGPLSASVLFEYRARRFLSLPSTQLDWLSLDDNQFRMSILERLEQMEKRMAEIAAAGQVPCQGPDAPPVQDEGQGPGFEARVVVLVESMIPRSTWKGPERLAHGSPFRGMSLLHLAAAQGYARLIETLSQWRSVETGSLDLEQEVDPLNVDHFSCTPLMWACALGHLEAAVLLFRWNRQALSIPDSLGRLPLSVAHSRGHVRLARCLEELQRQEPSVEPPFALSPPSSSPDTGLSSVSSPSELSDGTFSVTSAYSSAPDGSPPPAPLPASEMTMEDMAPGQLSSGVPEAPLLLMDYEATNSKGPLSSLPALPPASDDGAAPEDADSPQAVDVIPVDMISLAKQIIEATPERIKREDFVGLPEAGASMRERTGAVGLSETMSWLASYLENVDHFPSSTPPSELPFERGRLAVPSAPSWAEFLSASTSGKMESDFALLTLSDHEQRELYEAARVIQTAFRKYKGRRLKEQQEVAAAVIQRCYRKYKQLTWIALKFALYKKMTQAAILIQSKFRSYYEQKRFQQSRRAAVLIQQHYRSYRRRPGPPHRTSATLPARNKGSFLTKKQDQAARKIMRFLRRCRHRMRELKQNQELEGLPQPGLAT

SEQ ID NO: 11055 - protein, 1324 aa, Homo sapiens
  Payload ID: 2186;
  Gene Symbol: CAMSAP1;
  Gene Name: calmodulin regulated spectrin-associated prt 1;
  Uniprot ID:  Q5T5Y3;
  ENSP ID: ENSP00000312463
MADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 11056 - protein, 1602 aa, Homo sapiens
  Payload ID: 2186;
  Gene Symbol: CAMSAP1;
  Gene Name: calmodulin regulated spectrin-associated prt 1;
  Uniprot ID:  Q5T5Y3;
  ENSP ID: ENSP00000374183
MVDASGRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 11057 - protein, 1613 aa, Homo sapiens
  Payload ID: 2186;
  Gene Symbol: CAMSAP1;
  Gene Name: calmodulin regulated spectrin-associated prt 1;
  Uniprot ID:  Q5T5Y3;
  ENSP ID: ENSP00000386420
MVDASGRAAAEGWRKMEAPPDGAADLVPLDRYDAARAKIAANLQWICAKAYGRDNIPEDLRDPFYVDQYEQEHIKPPVIKLLLSSELYCRVCSLILKGDQVAALQGHQSVIQALSRKGIYVMESDDTPVTESDLSRAPIKMSAHMAMVDALMMAYTVEMISIEKVVASVKRFSTFSASKELPYDLEDAMVFWINKVNLKMREITEKEVKLKQQLLESPAHQKSPSKWYWKLVPVRYRREHLSARQSPYFPLLEDLMRDGSDGAALLAVIHYYCPEQMKLDDICLKEVTSMADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 11058 - protein, 1489 aa, Homo sapiens
  Payload ID: 2187;
  Gene Symbol: CAMSAP2;
  Gene Name: calmodulin regulated spectrin-associated prt family, member 2;
  Uniprot ID:  Q08AD1;
  ENSP ID: ENSP00000236925
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKSPSKWFWKLVPARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 11059 - protein, 1478 aa, Homo sapiens
  Payload ID: 2187;
  Gene Symbol: CAMSAP2;
  Gene Name: calmodulin regulated spectrin-associated prt family, member 2;
  Uniprot ID:  Q08AD1;
  ENSP ID: ENSP00000351684
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 11060 - protein, 133 aa, Homo sapiens
  Payload ID: 2187;
  Gene Symbol: CAMSAP2;
  Gene Name: calmodulin regulated spectrin-associated prt family, member 2;
  ENSP ID: ENSP00000395365
  MOD_RES (1)..(1): Any amino acid
XKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSSGEGATFTQSHHHLPSRYSRPQAHSSASG

SEQ ID NO: 11061 - protein, 1462 aa, Homo sapiens
  Payload ID: 2187;
  Gene Symbol: CAMSAP2;
  Gene Name: calmodulin regulated spectrin-associated prt family, member 2;
  Uniprot ID:  Q08AD1;
  ENSP ID: ENSP00000416800
MGDAADPREMRKTFIVPAIKPFDHYDFSRAKIACNLAWLVAKAFGTENVPEELQEPFYTDQYDQEHIKPPVVNLLLSAELYCRAGSLILKSDAAKPLLGHDAVIQALAQKGLYVTDQEKLVTERDLHKKPIQMSAHLAMIDTLMMAYTVEMVSIEKVIACAQQYSAFFQATDLPYDIEDAVMYWINKVNEHLKDIMEQEQKLKEHHTVEAPGGQKARYRKEQTLLKQLPCIPLVENLLKDGTDGCALAALIHFYCPDVVRLEDICLKETMSLADSLYNLQLIQEFCQEYLNQCCHFTLEDMLYAASSIKSNYLVFMAELFWWFEVVKPSFVQPRVVRPQGAEPVKDMPSIPVLNAAKRNVLDSSSDFPSRYSRPQAHSSASGGIRRSSSMSYVDGFIGTWPKEKRSSVHGVSFDISFDKEDSVQRSTPNRGITRSISNEGLTLNNSHVSKHIRKNLSFKPINGEEEAESIEEELNIDSHSDLKSCVPLNTNELNSNENIHYKLPNGALQNRILLDEFGNQIETPSIEEALQIIHDTEKSPHTPQPDQIANGFFLHSQEMSILNSNIKLNQSSPDNVTDTKGALSPITDNTEVDTGIHVPSEDIPETMDEDSSLRDYTVSLDSDMDDASKFLQDYDIRTGNTREALSPCPSTVSTKSQPGSSASSSSGVKMTSFAEQKFRKLNHTDGKSSGSSSQKTTPEGSELNIPHVVAWAQIPEETGLPQGRDTTQLLASEMVHLRMKLEEKRRAIEAQKKKMEAAFTKQRQKMGRTAFLTVVKKKGDGISPLREEAAGAEDEKVYTDRAKEKESQKTDGQRSKSLADIKESMENPQAKWLKSPTTPIDPEKQWNLASPSEETLNEGEILEYTKSIEKLNSSLHFLQQEMQRLSLQQEMLMQMREQQSWVISPPQPSPQKQIRDFKPSKQAGLSSAIAPFSSDSPRPTHPSPQSSNRKSASFSVKSQRTPRPNELKITPLNRTLTPPRSVDSLPRLRRFSPSQVPIQTRSFVCFGDDGEPQLKESKPKEEVKKEELESKGTLEQRGHNPEEKEIKPFESTVSEVLSLPVTETVCLTPNEDQLNQPTEPPPKPVFPPTAPKNVNLIEVSLSDLKPPEKADVPVEKYDGESDKEQFDDDQKVCCGFFFKDDQKAENDMAMKRAALLEKRLRREKETQLRKQQLEAEMEHKKEETRRKTEEERQKKEDERARREFIRQEYMRRKQLKLMEDMDTVIKPRPQVVKQKKQRPKSIHRDHIESPKTPIKGPPVSSLSLASLNTGDNESVHSGKRTPRSESVEGFLSPSRCGSRNGEKDWENASTTSSVASGTEYTGPKLYKEPSAKSNKHIIQNALAHCCLAGKVNEGQKKKILEEMEKSDANNFLILFRDSGCQFRSLYTYCPETEEINKLTGIGPKSITKKMIEGLYKYNSDRKQFSHIPAKTLSASVDAITIHSHLWQTKRPVTPKKLLPTKA

SEQ ID NO: 11062 - protein, 56 aa, Homo sapiens
  Payload ID: 2187;
  Gene Symbol: CAMSAP2;
  Gene Name: calmodulin regulated spectrin-associated prt family, member 2;
  ENSP ID: ENSP00000434766
  MOD_RES (1)..(1): Any amino acid
XSSVASGTEYTGPKLYKEPSAKSNKHIIQNALAHCCLAGKVNEGQKKKILEVSMFA

SEQ ID NO: 11063 - protein, 1249 aa, Homo sapiens
  Payload ID: 2188;
  Gene Symbol: CAMSAP3;
  Gene Name: calmodulin regulated spectrin-associated prt family, member 3;
  Uniprot ID:  Q9P1Y5;
  ENSP ID: ENSP00000160298
MVEAAPPGPGPLRRTFLVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 11064 - protein, 1276 aa, Homo sapiens
  Payload ID: 2188;
  Gene Symbol: CAMSAP3;
  Gene Name: calmodulin regulated spectrin-associated prt family, member 3;
  Uniprot ID:  Q9P1Y5;
  ENSP ID: ENSP00000416797
MVEAAPPGPGPLRRTFLVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSCPTRWYWKLVPHAIAFCLKESGSKPPMIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 11065 - protein, 149 aa, Homo sapiens
  Payload ID: 2189;
  Gene Symbol: CALML3;
  Gene Name: calmodulin-like 3;
  Uniprot ID:  P27482;
  ENSP ID: ENSP00000315299
MADQLTEEQVTEFKEAFSLFDKDGDGCITTRELGTVMRSLGQNPTEAELRDMMSEIDRDGNGTVDFPEFLGMMARKMKDTDNEEEIREAFRVFDKDGNGFVSAAELRHVMTRLGEKLSDEEVDEMIRAADTDGDGQVNYEEFVRVLVSK

SEQ ID NO: 11066 - protein, 59 aa, Homo sapiens
  Payload ID: 2190;
  Gene Symbol: CALML4;
  Gene Name: calmodulin-like 4;
  Uniprot ID:  Q96GE6;
  ENSP ID: ENSP00000378848
MAAEHLLPGPPPSLADFRLEAGGKGTERGSGSSKPTGSSRGPRMWMISSGKQISNPMAK

SEQ ID NO: 11067 - protein, 149 aa, Homo sapiens
  Payload ID: 2190;
  Gene Symbol: CALML4;
  Gene Name: calmodulin-like 4;
  Uniprot ID:  Q96GE6;
  ENSP ID: ENSP00000400755
MAAEHLLPGPPPSLADFRLEAGGKGTERGSGSSKPTGSSRGPRMAKFLSQDQINDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 11068 - protein, 196 aa, Homo sapiens
  Payload ID: 2190;
  Gene Symbol: CALML4;
  Gene Name: calmodulin-like 4;
  Uniprot ID:  Q96GE6;
  ENSP ID: ENSP00000419081
MAAEHLLPGPPPSLADFRLEAGGKGTERGSGSSKPTGSSRGPRMAKFLSQDQINEYKECFSLYDKQQRGKIKATDLMVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 11069 - protein, 29 aa, Homo sapiens
  Payload ID: 2190;
  Gene Symbol: CALML4;
  Gene Name: calmodulin-like 4;
  ENSP ID: ENSP00000432629
ERGSGSSKPTGSSRGPRMTEMESWISPLF

SEQ ID NO: 11070 - protein, 60 aa, Homo sapiens
  Payload ID: 2190;
  Gene Symbol: CALML4;
  Gene Name: calmodulin-like 4;
  ENSP ID: ENSP00000435285
MAAEHLLPGPPPSLADFRLEAGGKGTERGSGSSKPTGSSRGPRMSTRNASPCMTSSRGGR

SEQ ID NO: 11071 - protein, 120 aa, Homo sapiens
  Payload ID: 2190;
  Gene Symbol: CALML4;
  Gene Name: calmodulin-like 4;
  Uniprot ID:  Q96GE6;
  ENSP ID: ENSP00000438177
MVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 11072 - protein, 88 aa, Homo sapiens
  Payload ID: 2190;
  Gene Symbol: CALML4;
  Gene Name: calmodulin-like 4;
  ENSP ID: ENSP00000456532
MVAMRCLGASPTPGEVQRHLQTHGIDGNGELDFSTFLTIMHMQIKQEDPKKEILLAMLMVDKEKKGYVMASDLRSKLTSLGEKLTHKE

SEQ ID NO: 11073 - protein, 146 aa, Homo sapiens
  Payload ID: 2191;
  Gene Symbol: CALML5;
  Gene Name: calmodulin-like 5;
  Uniprot ID:  Q9NZT1;
  ENSP ID: ENSP00000369689
MAGELTPEEEAQYKKAFSAVDTDGNGTINAQELGAALKATGKNLSEAQLRKLISEVDSDGDGEISFQEFLTAAKKARAGLEDLQVAFRAFDQDGDGHITVDELRRAMAGLGQPLPQEELDAMIREADVDQDGRVNYEEFARMLAQE

SEQ ID NO: 11074 - protein, 181 aa, Homo sapiens
  Payload ID: 2192;
  Gene Symbol: CALML6;
  Gene Name: calmodulin-like 6;
  Uniprot ID:  Q8TD86;
  ENSP ID: ENSP00000304643
MGLQQEISLQPWCHHPAESCQTTTDMTERLSAEQIKEYKGVFEMFDEEGNGEVKTGELEWLMSLLGINPTKSELASMAKDVDRDNKGFFNCDGFLALMGVYHEKAQNQESELRAAFRVFDKEGKGYIDWNTLKYVLMNAGEPLNEVEAEQMMKEADKDGDRTIDYEEFVAMMTGESFKLIQ

SEQ ID NO: 11075 - protein, 164 aa, Homo sapiens
  Payload ID: 2192;
  Gene Symbol: CALML6;
  Gene Name: calmodulin-like 6;
  ENSP ID: ENSP00000367867
MGLQQEISLTERLSAEQIKEYKGVFEMFDEEGNGEVKTGELEWLMSLLGINPTKSELASMAKDVDRDNKGFFNCDGFLALMGVYHEKAQNQESELRAAFRVFDKEGKGYIDWNTLKYVLMNAGEPLNEVEAEQMMKEADKDGDRTIDYEEFVAMMTGESFKLIQ

SEQ ID NO: 11076 - protein, 323 aa, Homo sapiens [sequence omitted]

SEQ ID NO: 11077 - protein, 136 aa, Homo sapiens
  Payload ID: 2193;
  Gene Symbol: CAMKMT;
  Gene Name: calmodulin-lysine N- methyltransferase;
  ENSP ID: ENSP00000384039
MESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVYDVSLYCPCWS

SEQ ID NO: 11078 - protein, 132 aa, Homo sapiens
  Payload ID: 2193;
  Gene Symbol: CAMKMT;
  Gene Name: calmodulin-lysine N- methyltransferase;
  Uniprot ID:  Q7Z624;
  ENSP ID: ENSP00000385124
MESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVWEATRGK

SEQ ID NO: 11079 - protein, 139 aa, Homo sapiens
  Payload ID: 2193;
  Gene Symbol: CAMKMT;
  Gene Name: calmodulin-lysine N- methyltransferase;
  ENSP ID: ENSP00000385587
MESRVADAGTGETARAAGGSPAVGCTTRGPVVSAPLGAARWKLLRQVLKQKHLDDCLRHVSVRRFESFNLFSVTEGKERETEEEVGAWVQYTSIFCPEYSISLRHNSGSLNVEDVLTSFDNTGNVYTGSHSVAQAGVQW

SEQ ID NO: 11080 - protein, 93 aa, Homo sapiens
  Payload ID: 2193;
  Gene Symbol: CAMKMT;
  Gene Name: calmodulin-lysine N- methyltransferase;
  ENSP ID: ENSP00000406936
  MOD_RES (1)..(1): Any amino acid
XAPLGAARWKLLRQVLKQKHLDDCLRHVSVRRFESFNLFSVTEGKERETEEEVGAWVQYTSIFCPEYSISLRHNSGSLNVEDVLTSFDNTGNV

SEQ ID NO: 11081 - protein, 71 aa, Homo sapiens
  Payload ID: 2193;
  Gene Symbol: CAMKMT;
  Gene Name: calmodulin-lysine N- methyltransferase;
  ENSP ID: ENSP00000407594
  MOD_RES (1)..(1): Any amino acid
XCLRHVSVRRFESFNLFSVTEGKERETEEEVGAWVQYTSIFCPEYSISLRHNSGSLNVEDVLTSFDNTGNV

SEQ ID NO: 11082 - protein, 83 aa, Homo sapiens
  Payload ID: 2193;
  Gene Symbol: CAMKMT;
  Gene Name: calmodulin-lysine N- methyltransferase;
  ENSP ID: ENSP00000410783
  MOD_RES (1)..(1): Any amino acid
XRHVSVRRFESFNLFSVTEGKERETEEEVGAWVQYTSIFCPEYSISLRHNSGSLNVEDVLTSFDNTGNVYTGSHSVAQAGVQW

SEQ ID NO: 11083 - protein, 197 aa, Homo sapiens
  Payload ID: 2193;
  Gene Symbol: CAMKMT;
  Gene Name: calmodulin-lysine N- methyltransferase;
  ENSP ID: ENSP00000482360
IWPSEEVLAYYCLKHNNIFRALAVCELGGGMTCLAGLMVAISADVKEVLLTDGNEKAIRNVQDIITRNQKAGVFKTQKISSCVLRWDNETDVSQLEGHFDIVMCADCLFLDQYRASLVDAIKRLLQPRGKAMVFAPRRGNTLNQFCNLAEKAGFCIQRHENYDEHISNFHSKLKKENPDIYEENLHYPLLLILTKHG

SEQ ID NO: 11084 - protein, 219 aa, Homo sapiens
  Payload ID: 2194;
  Gene Symbol: CALN1;
  Gene Name: calneuron 1;
  Uniprot ID:  Q9BXU9;
  ENSP ID: ENSP00000332498
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 11085 - protein, 261 aa, Homo sapiens
  Payload ID: 2194;
  Gene Symbol: CALN1;
  Gene Name: calneuron 1;
  Uniprot ID:  Q9BXU9;
  ENSP ID: ENSP00000378690
MRLPEQPGEGKPENEKKGDGGALGGGEEPPRSQAPDFPTWEKMPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 11086 - protein, 219 aa, Homo sapiens; identical to SEQ ID NO: 11084
  Payload ID: 2194;
  Gene Symbol: CALN1;
  Gene Name: calneuron 1;
  Uniprot ID:  Q9BXU9;
  ENSP ID: ENSP00000378691

SEQ ID NO: 11087 - protein, 95 aa, Homo sapiens
  Payload ID: 2194;
  Gene Symbol: CALN1;
  Gene Name: calneuron 1;
  ENSP ID: ENSP00000384354
QFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 11088 - protein, 219 aa, Homo sapiens; identical to SEQ ID NO: 11084
  Payload ID: 2194;
  Gene Symbol: CALN1;
  Gene Name: calneuron 1;
  Uniprot ID:  Q9BXU9;
  ENSP ID: ENSP00000410704

SEQ ID NO: 11089 - protein, 125 aa, Homo sapiens
  Payload ID: 2194;
  Gene Symbol: CALN1;
  Gene Name: calneuron 1;
  ENSP ID: ENSP00000411806
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQ

SEQ ID NO: 11090 - protein, 592 aa, Homo sapiens
  Payload ID: 2195;
  Gene Symbol: CANX;
  Gene Name: calnexin;
  Uniprot ID:  P27824;
  ENSP ID: ENSP00000247461
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 11091 - protein, 592 aa, Homo sapiens; identical to SEQ ID NO: 11090
  Payload ID: 2195;
  Gene Symbol: CANX;
  Gene Name: calnexin;
  Uniprot ID:  P27824;
  ENSP ID: ENSP00000391646

SEQ ID NO: 11092 - protein, 308 aa, Homo sapiens
  Payload ID: 2195;
  Gene Symbol: CANX;
  Gene Name: calnexin;
  ENSP ID: ENSP00000421107
MEGKWLLCMLLVLGTAIVEAHDGHDDDVIDIEDDLDDVIEEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRP

SEQ ID NO: 11093 - protein, 32 aa, Homo sapiens
  Payload ID: 2195;
  Gene Symbol: CANX;
  Gene Name: calnexin;
  ENSP ID: ENSP00000421434
MEGKWLLCMLLVLGTAIVEAHDGHDDDVIDIE

SEQ ID NO: 11094 - protein, 107 aa, Homo sapiens
  Payload ID: 2195;
  Gene Symbol: CANX;
  Gene Name: calnexin;
  ENSP ID: ENSP00000421813
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVE

SEQ ID NO: 11095 - protein, 592 aa, Homo sapiens; identical to SEQ ID NO: 11090
  Payload ID: 2195;
  Gene Symbol: CANX;
  Gene Name: calnexin;
  Uniprot ID:  P27824;
  ENSP ID: ENSP00000424063

SEQ ID NO: 11096 - protein, 189 aa, Homo sapiens
  Payload ID: 2195;
  Gene Symbol: CANX;
  Gene Name: calnexin;
  ENSP ID: ENSP00000424140
  MOD_RES (1)..(1): Any amino acid
XGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLKSRGTNHLCFVHKEMGVSFPKTPGARHCSYPKASVLNPDNSFEILVDQSVVNSGNLLNDMTPPVNP

SEQ ID NO: 11097 - protein, 144 aa, Homo sapiens
  Payload ID: 2195;
  Gene Symbol: CANX;
  Gene Name: calnexin;
  ENSP ID: ENSP00000424341
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTK

SEQ ID NO: 11098 - protein, 170 aa, Homo sapiens
  Payload ID: 2195;
  Gene Symbol: CANX;
  Gene Name: calnexin;
  ENSP ID: ENSP00000424740
  MOD_RES (1)..(1): Any amino acid
XLYCGAGQGVRAGRGTGTPAVPGRLEVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLH

SEQ ID NO: 11099 - protein, 134 aa, Homo sapiens
  Payload ID: 2195;
  Gene Symbol: CANX;
  Gene Name: calnexin;
  ENSP ID: ENSP00000424745
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAK

SEQ ID NO: 11100 - protein, 168 aa, Homo sapiens
  Payload ID: 2195;
  Gene Symbol: CANX;
  Gene Name: calnexin;
  ENSP ID: ENSP00000425246
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLL

SEQ ID NO: 11101 - protein, 78 aa, Homo sapiens
  Payload ID: 2195;
  Gene Symbol: CANX;
  Gene Name: calnexin;
  ENSP ID: ENSP00000426052
MEGKWLLCMLLVLGTAIVEAHDGHDDDVIDIEDDLDDVIEEVEDSKPDTTAPPSSPKVTYKAPVPTGEVYFADSFDRG

SEQ ID NO: 11102 - protein, 61 aa, Homo sapiens
  Payload ID: 2195;
  Gene Symbol: CANX;
  Gene Name: calnexin;
  ENSP ID: ENSP00000426425
MEGKWLLCMLLVLGTAIVEAHDGHDDDVIDIEDDLDDVIEEVEDSKPDTTAPPSSPKESGR

SEQ ID NO: 11103 - protein, 131 aa, Homo sapiens
  Payload ID: 2195;
  Gene Symbol: CANX;
  Gene Name: calnexin;
  ENSP ID: ENSP00000426555
MKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYT

SEQ ID NO: 11104 - protein, 96 aa, Homo sapiens
  Payload ID: 2195;
  Gene Symbol: CANX;
  Gene Name: calnexin;
  ENSP ID: ENSP00000427115
MEGKWLLCMLLVLGTAIVEAHDGHDDDVIDIEDDLDDVIEEVEDSKPDTTAPPSSPKVTYKAPVPTGEVYFADSFDRGTLSGKVGGRGNEGVKASR

SEQ ID NO: 11105 - protein, 714 aa, Homo sapiens
  Payload ID: 2196;
  Gene Symbol: CAPN1;
  Gene Name: calpain 1, (mu/I) large subunit;
  Uniprot ID:  P07384;
  ENSP ID: ENSP00000279247
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 11106 - protein, 152 aa, Homo sapiens
  Payload ID: 2196;
  Gene Symbol: CAPN1;
  Gene Name: calpain 1, (mu/I) large subunit;
  ENSP ID: ENSP00000431172
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQ

SEQ ID NO: 11107 - protein, 161 aa, Homo sapiens
  Payload ID: 2196;
  Gene Symbol: CAPN1;
  Gene Name: calpain 1, (mu/I) large subunit;
  ENSP ID: ENSP00000431528
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVD

SEQ ID NO: 11108 - protein, 714 aa, Homo sapiens; identical to SEQ ID NO: 11105
  Payload ID: 2196;
  Gene Symbol: CAPN1;
  Gene Name: calpain 1, (mu/I) large subunit;
  Uniprot ID:  P07384;
  ENSP ID: ENSP00000431686

SEQ ID NO: 11109 - protein, 135 aa, Homo sapiens
  Payload ID: 2196;
  Gene Symbol: CAPN1;
  Gene Name: calpain 1, (mu/I) large subunit;
  ENSP ID: ENSP00000431793
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVV

SEQ ID NO: 11110 - protein, 714 aa, Homo sapiens; identical to SEQ ID NO: 11105
  Payload ID: 2196;
  Gene Symbol: CAPN1;
  Gene Name: calpain 1, (mu/I) large subunit;
  Uniprot ID:  P07384;
  ENSP ID: ENSP00000431984

SEQ ID NO: 11111 - protein, 191 aa, Homo sapiens
  Payload ID: 2196;
  Gene Symbol: CAPN1;
  Gene Name: calpain 1, (mu/I) large subunit;
  ENSP ID: ENSP00000432512
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALL

SEQ ID NO: 11112 - protein, 191 aa, Homo sapiens
  Payload ID: 2196;
  Gene Symbol: CAPN1;
  Gene Name: calpain 1, (mu/I) large subunit;
  ENSP ID: ENSP00000433366
MCIPPAPGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRN

SEQ ID NO: 11113 - protein, 161 aa, Homo sapiens; identical to SEQ ID NO: 11107
  Payload ID: 2196;
  Gene Symbol: CAPN1;
  Gene Name: calpain 1, (mu/I) large subunit;
  ENSP ID: ENSP00000433823

SEQ ID NO: 11114 - protein, 714 aa, Homo sapiens; identical to SEQ ID NO: 11105
  Payload ID: 2196;
  Gene Symbol: CAPN1;
  Gene Name: calpain 1, (mu/I) large subunit;
  Uniprot ID:  P07384;
  ENSP ID: ENSP00000434176

SEQ ID NO: 11115 - protein, 122 aa, Homo sapiens
  Payload ID: 2196;
  Gene Symbol: CAPN1;
  Gene Name: calpain 1, (mu/I) large subunit;
  ENSP ID: ENSP00000435092
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIA

SEQ ID NO: 11116 - protein, 148 aa, Homo sapiens
  Payload ID: 2196;
  Gene Symbol: CAPN1;
  Gene Name: calpain 1, (mu/I) large subunit;
  ENSP ID: ENSP00000435198
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGI

SEQ ID NO: 11117 - protein, 714 aa, Homo sapiens; identical to SEQ ID NO: 11105
  Payload ID: 2196;
  Gene Symbol: CAPN1;
  Gene Name: calpain 1, (mu/I) large subunit;
  Uniprot ID:  P07384;
  ENSP ID: ENSP00000435272

SEQ ID NO: 11118 - protein, 163 aa, Homo sapiens
  Payload ID: 2196;
  Gene Symbol: CAPN1;
  Gene Name: calpain 1, (mu/I) large subunit;
  ENSP ID: ENSP00000435847
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVV

SEQ ID NO: 11119 - protein, 201 aa, Homo sapiens
  Payload ID: 2196;
  Gene Symbol: CAPN1;
  Gene Name: calpain 1, (mu/I) large subunit;
  ENSP ID: ENSP00000436002
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKSPAF

SEQ ID NO: 11120 - protein, 63 aa, Homo sapiens
  Payload ID: 2196;
  Gene Symbol: CAPN1;
  Gene Name: calpain 1, (mu/I) large subunit;
  ENSP ID: ENSP00000436693
MSEEIITPVYCTGVSAQVQKQRARELGLGRHENAIKYLGQDYEQLRVRCLQSGTLFRDEAFPP

SEQ ID NO: 11121 - protein, 274 aa, Homo sapiens
  Payload ID: 2197;
  Gene Symbol: CAPN10;
  Gene Name: calpain 10;
  Uniprot ID:  Q9HC96;
  ENSP ID: ENSP00000270361
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKGPWVLRAPVGRAGGGCPGGPDRRPGRKMEPEGRSRKRRPAGQARPLGAQDLSAAAPPEGPVSDQLLRAQPQSRCPGAGGVPCLHCLGPAGAPGSGGPVHPAAADPEPLGPAVLAGALERGG

SEQ ID NO: 11122 - protein, 517 aa, Homo sapiens
  Payload ID: 2197;
  Gene Symbol: CAPN10;
  Gene Name: calpain 10;
  Uniprot ID:  Q9HC96;
  ENSP ID: ENSP00000270362
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 11123 - protein, 139 aa, Homo sapiens
  Payload ID: 2197;
  Gene Symbol: CAPN10;
  Gene Name: calpain 10;
  Uniprot ID:  Q9HC96;
  ENSP ID: ENSP00000270364
MRAGRGATPARELFRDAAFPAADSSLFCDLSTPLAQFREDITWRRPQEICATPRLFPDDPREGQVKQGLLGDCWFLCACAALQKSRHLLDQVSCPVQLPADWTCKVQPVWLEFPCLPISCRLRVSSDTSPDSATWGSWK

SEQ ID NO: 11124 - protein, 138 aa, Homo sapiens
  Payload ID: 2197;
  Gene Symbol: CAPN10;
  Gene Name: calpain 10;
  Uniprot ID:  Q9HC96;
  ENSP ID: ENSP00000289381
MRAGRGATPARELFRDAAFPAADSSLFCDLSTPLAQFREDITWRRPQVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 11125 - protein, 513 aa, Homo sapiens
  Payload ID: 2197;
  Gene Symbol: CAPN10;
  Gene Name: calpain 10;
  Uniprot ID:  Q9HC96;
  ENSP ID: ENSP00000349556
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRSQRVEGARTHPHCCCRSRC

SEQ ID NO: 11126 - protein, 544 aa, Homo sapiens
  Payload ID: 2197;
  Gene Symbol: CAPN10;
  Gene Name: calpain 10;
  Uniprot ID:  Q9HC96;
  ENSP ID: ENSP00000375843
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRALAPAASASLCISTAGPVTPSSTPSASISSRSQRVEGARTHPHCCCRSRC

SEQ ID NO: 11127 - protein, 672 aa, Homo sapiens
  Payload ID: 2197;
  Gene Symbol: CAPN10;
  Gene Name: calpain 10;
  Uniprot ID:  Q9HC96;
  ENSP ID: ENSP00000375844
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 11128 - protein, 653 aa, Homo sapiens
  Payload ID: 2197;
  Gene Symbol: CAPN10;
  Gene Name: calpain 10;
  ENSP ID: ENSP00000384422
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRSPSWQ

SEQ ID NO: 11129 - protein, 444 aa, Homo sapiens
  Payload ID: 2197;
  Gene Symbol: CAPN10;
  Gene Name: calpain 10;
  Uniprot ID:  Q9HC96;
  ENSP ID: ENSP00000400144
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKGVTLGTTLFPVPSWMWPT

SEQ ID NO: 11130 - protein, 46 aa, Homo sapiens
  Payload ID: 2197;
  Gene Symbol: CAPN10;
  Gene Name: calpain 10;
  ENSP ID: ENSP00000404064
  MOD_RES (1)..(1): Any amino acid
XSTYLPDTEGAFTVTIATRIDRPSIHSQEMLGQFLQEVSIMAVMKT

SEQ ID NO: 11131 - protein, 85 aa, Homo sapiens
  Payload ID: 2197;
  Gene Symbol: CAPN10;
  Gene Name: calpain 10;
  ENSP ID: ENSP00000407090
LEKVYAKVHGSYEHLWAGQVADALVDLTGGLAERWNLKGVAGSGGQQDRPGRWEHRTCRQLLHLKDQCLISCCVLSPRAVIDNIR

SEQ ID NO: 11132 - protein, 739 aa, Homo sapiens [sequence omitted]

SEQ ID NO: 11133 - protein, 40 aa, Homo sapiens
  Payload ID: 2198;
  Gene Symbol: CAPN11;
  Gene Name: calpain 11;
  ENSP ID: ENSP00000431963
MLYSPGPQESSTPSVLGAARVEAAWSDCTVQGHGVVCLIV

SEQ ID NO: 11134 - protein, 182 aa, Homo sapiens
  Payload ID: 2198;
  Gene Symbol: CAPN11;
  Gene Name: calpain 11;
  ENSP ID: ENSP00000432420
MLYSPGPSLPESAESLDGSQEDKPRGSCAETRSCSVTQTGVPSHLIAASNCHSLELQGSEPTFTDTGMVAHINNSRLKAKGVGQHDNAQNFGNQSFEELRAACLRKGELFEDPLFPAEPSSLGFKDLGPNSKNVQNISWQRPKDIINNPLFIMDGISPTDICQGILGDCWLLAAIGSLTTCP

SEQ ID NO: 11135 - protein, 719 aa, Homo sapiens
  Payload ID: 2199;
  Gene Symbol: CAPN12;
  Gene Name: calpain 12;
  Uniprot ID:  Q6ZSI9;
  ENSP ID: ENSP00000331636
MASSSGRVTIQLVDEEAGVGAGRLQLFRGQSYEAIRAACLDSGILFRDPYFPAGPDALGYDQLGPDSEKAKGVKWMRPHEFCAEPKFICEDMSRTDVCQGSLGNCWFLAAAASLTLYPRLLRRVVPPGQDFQHGYAGVFHFQLWQFGRWMDVVVDDRLPVREGKLMFVRSEQRNEFWAPLLEKAYAKLHGSYEVMRGGHMNEAFVDFTGGVGEVLYLRQNSMGLFSALRHALAKESLVGATALSDRGEYRTEEGLVKGHAYSITGTHKVFLGFTKVRLLRLRNPWGCVEWTGAWSDSCPRWDTLPTECRDALLVKKEDGEFWMELRDFLLHFDTVQICSLSPEVLGPSPEGGGWHVHTFQGRWVRGFNSGGSQPNAETFWTNPQFRLTLLEPDEEDDEDEEGPWGGWGAAGARGPARGGRTPKCTVLLSLIQRNRRRLRAKGLTYLTVGFHVFQIPEELLGLWDSPRSHALLPRLLRADRSPLSARRDVTRRCCLRPGHYLVVPSTAHAGDEADFTLRVFSERRHTAVEIDDVISADLQSLQGPYLPLELGLEQLFQELAGEEEELNASQLQALLSIALEPARAHTSTPREIGLRTCEQLLQCFGHGQSLALHHFQQLWGYLLEWQAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 11136 - protein, 36 aa, Homo sapiens
  Payload ID: 2199;
  Gene Symbol: CAPN12;
  Gene Name: calpain 12;
  ENSP ID: ENSP00000469217
  MOD_RES (1)..(1): Any amino acid
XLGLEQLFQELAGEEEELNASQLQALLSIALEPGHI

SEQ ID NO: 11137 - protein, 179 aa, Homo sapiens
  Payload ID: 2199;
  Gene Symbol: CAPN12;
  Gene Name: calpain 12;
  ENSP ID: ENSP00000470233
MASSSGRVTIQLVDEEAGVGAGRLQLFRGQSYEAIRAACLDSGILFRDPYFPAGPDALGYDQLGPDSEKAKGVKWMRPHEFCAEPKFICEDMSRTDVCQGSLAAASLTLYPRLLRRVVPPGQDFQHGYAGVFHFQLWQFGRWMDVVVDDRLPVREGKLMFVRSEQRNEFWAPLLEKAYA

SEQ ID NO: 11138 - protein, 105 aa, Homo sapiens
  Payload ID: 2199;
  Gene Symbol: CAPN12;
  Gene Name: calpain 12;
  ENSP ID: ENSP00000470760
GLEQLFQELAGEAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 11139 - protein, 104 aa, Homo sapiens
  Payload ID: 2199;
  Gene Symbol: CAPN12;
  Gene Name: calpain 12;
  ENSP ID: ENSP00000471007
  MOD_RES (1)..(1): Any amino acid
XLPLELGLEQLFQELAGEEEELNASQLQALLSIALEPGFHLNNQLTQTLTSRYRDSRLRVDFERFVSCVAHLTCIFCHCSQHLDGGEGVICLTHRQWMEVATFS

SEQ ID NO: 11140 - protein, 93 aa, Homo sapiens
  Payload ID: 2199;
  Gene Symbol: CAPN12;
  Gene Name: calpain 12;
  ENSP ID: ENSP00000471510
MASSSGRVTIQLVDEEAGVGAGRLQLFRGQSYEAIRAACLDSGILFRDPYFPAGPDALGYDQLGPDSEKAKGVKWMRPHAEAWNPPPPTGVLC

SEQ ID NO: 11141 - protein, 570 aa, Homo sapiens
  Payload ID: 2199;
  Gene Symbol: CAPN12;
  Gene Name: calpain 12;
  ENSP ID: ENSP00000473156
MDVVVDDRLPVREGKLMFVRSEQRNEFWAPLLEKAYAKLHGSYEVMRGGHMNEAFVDFTGGVGEVLYLRQNSMGLFSALRHALAKESLVGATALSDRGEYRTEEGLVKGHAYSITGTHKVFLGFTKVRLLRLRNPWGCVEWTGAWSDSCPRWDTLPTECRDALLVKKEDGEFWMELRDFLLHFDTVQICSLSPEVLGPSPEGGGWHVHTFQGRWVRGFNSGGSQPNAETFWTNPQFRLTLLEPDEEDDEDEEGPWGGWGAAGARGPARGGRTPKCTVLLSLIQRNRRRLRAKGLTYLTVGFHVFQIPEELLGLWDSPRSHALLPRLLRADRSPLSARRDVTRRCCLRPGHYLVVPSTAHAGDEADFTLRVFSERRHTAVEIDDVISADLQSLQGPYLPLELGLEQLFQELAGEEEELNASQLQALLSIALEPARAHTSTPREIGLRTCEQLLQCFGHGQSLALHHFQQLWGYLLEWQAIFNKFDEDTSGTMNSYELRLALNAAGFHLNNQLTQTLTSRYRDSRLRVDFERFVSCVAHLTCIFCHCSQHLDGGEGVICLTHRQWMEVATFS

SEQ ID NO: 11142 - protein, 719 aa, Homo sapiens; identical to SEQ ID NO: 11135
  Payload ID: 2199;
  Gene Symbol: CAPN12;
  Gene Name: Calpain 12;
  ENSP ID: ENSP00000488980

SEQ ID NO: 11143 - protein, 669 aa, Homo sapiens
  Payload ID: 2200;
  Gene Symbol: CAPN13;
  Gene Name: calpain 13;
  Uniprot ID:  Q6MZZ7;
  ENSP ID: ENSP00000295055
MAYYQEPSVETSIIKFKDQDFTTLRDHCLSMGRTFKDETFPAADSSIGQKLLQEKRLSNVIWKRPQDLPGGPPHFILDDISRFDIQQGGAADCWFLAALGSLTQNPQYRQKILMVQSFSHQYAGIFRFRFWQCGQWVEVVIDDRLPVQGDKCLFVRPRHQNQEFWPCLLEKAYAKLLGSYSDLHYGFLEDALVDLTGGVITNIHLHSSPVDLVKAVKTATKAGSLITCATPSGPTDTAQAMENGLVSLHAYTVTGAEQIQYRRGWEEIISLWNPWGWGEAEWRGRWSDGSQEWEETCDPRKSQLHKKREDGEFWMSCQDFQQKFIAMFICSEIPITLDHGNTLHEGWSQIMFRKQVILGNTAGGPRNDAQFNFSVQEPMEGTNVVVCVTVAVTPSNLKAEDAKFPLDFQVILAGSQRFREKFPPVFFSSFRNTVQSSNNKFRRNFTMTYHLSPGNYVVVAQTRRKSAEFLLRIFLKMPDSDRHLSSHFNLRMKGSPSEHGSQQSIFNRYAQQRLDIDATQLQGLLNQELLTGPPGDMFSLDECRSLVALMELKVNGRLDQEEFARLWKRLVHYQHVFQKVQTSPGVLLSSDLWKAIENTDFLRGIFISRELLHLVTLRYSDSVGRVSFPSLVCFLMRLEAMAKTFRNLSKDGKGLYLTEMEWMSLVMYN

SEQ ID NO: 11144 - protein, 125 aa, Homo sapiens
  Payload ID: 2200;
  Gene Symbol: CAPN13;
  Gene Name: calpain 13;
  ENSP ID: ENSP00000403180
  MOD_RES (1)..(1): Any amino acid
XNNKFRRNFTMTYHLSPGNYVVVAQTRRKSAEFLLRIFLKMPDSDRHLSSHFNLRMKGSPSEHGSQQSIFNRYAQQRLDIDATQLQGLLNQELLTGPPGDMFSLDECRSLVALMEVSFAVIPPML

SEQ ID NO: 11145 - protein, 423 aa, Homo sapiens
  Payload ID: 2200;
  Gene Symbol: CAPN13;
  Gene Name: calpain 13;
  Uniprot ID:  Q6MZZ7;
  ENSP ID: ENSP00000416191
MAYYQEPSVETSIIKFKDQDFTTLRDHCLSMGRTFKDETFPAADSSIGQKLLQEKRLSNVIWKRPQDLPGGPPHFILDDISRFDIQQGGAADCWFLAALGSLTQNPQYRQKILMVQSFSHQYAGIFRFRFWQCGQWVEVVIDDRLPVQGDKCLFVRPRHQNQEFWPCLLEKAYAKLLGSYSDLHYGFLEDALVDLTGGVITNIHLHSSPVDLVKAVKTATKAGSLITCATPSGPTDTAQAMENGLVSLHAYTVTGAEQIQYRRGWEEIISLWNPWGWGEAEWRGRWSDGSQEWEETCDPRKSQLHKKREDGEFWMSCQDFQQKFIAMFICSEIPITLDHGNTLHEGWSQIMFRKQVILGNTAGGPRNDAQFNFSVQEPMEGTNVVVCVTVAVTPSNLKAEDAKFPLDFQVILAGSQKHCPKLK

SEQ ID NO: 11146 - protein, 102 aa, Homo sapiens
  Payload ID: 2200;
  Gene Symbol: CAPN13;
  Gene Name: calpain 13;
  ENSP ID: ENSP00000440723
MAYYQEPSVETSIIKFKDQDFTTLRDHCLSMGRTFKDETFPAADSSIGQKLLQEKRLSNVIWKRPQDLPGGPPHFILDDISRFDIQQGGAVLAMWPVGGSGD

SEQ ID NO: 11147 - protein, 143 aa, Homo sapiens
  Payload ID: 2201;
  Gene Symbol: CAPN14;
  Gene Name: calpain 14;
  ENSP ID: ENSP00000381805
MSLWPPFRCRWKLAPRYSRRASPQQPQQDFEALLAECLRNGCLFEDTSFPATLSSIGSGSLLQKLPPRLQWKRPPELHSNPQFYFAKAKRLDLCQGIVGDCWFLAALQALALHQDILSRVVPLNQSFTEKYAGIFRFWALWFL

SEQ ID NO: 11148 - protein, 684 aa, Homo sapiens
  Payload ID: 2201;
  Gene Symbol: CAPN14;
  Gene Name: calpain 14;
  Uniprot ID:  A8MX76;
  ENSP ID: ENSP00000385247
MSLWPPFRCRWKLAPRYSRRASPQQPQQDFEALLAECLRNGCLFEDTSFPATLSSIGSGSLLQKLPPRLQWKRPPELHSNPQFYFAKAKRLDLCQGIVGDCWFLAALQALALHQDILSRVVPLNQSFTEKYAGIFRFWFWHYGNWVPVVIDDRLPVNEAGQLVFVSSTYKNLFWGALLEKAYAKLSGSYEDLQSGQVSEALVDFTGGVTMTINLAEAHGNLWDILIEATYNRTLIGCQTHSGEKILENGLVEGHAYTLTGIRKVTCKHRPEYLVKLRNPWGKVEWKGDWSDSSSKWELLSPKEKILLLRKDNDGEFWMTLQDFKTHFVLLVICKLTPGLLSQEAAQKWTYTMREGRWEKRSTAGGQRQLLQDTFWKNPQFLLSVWRPEEGRRSLRPCSVLVSLLQKPRHRCRKRKPLLAIGFYLYRMNKYHDDQRRLPPEFFQRNTPLSQPDRFLKEKEVSQELCLEPGTYLIVPCILEAHQKSEFVLRVFSRKHIFYEIGSNSGVVFSKEIEDQNERQDEFFTKFFEKHPEINAVQLQNLLNQMTWSSLGSRQPFFSLEACQGILALLDLNASGTMSIQEFRDLWKQLKLSQKVFHKQDRGSGYLNWEQLHAAMREAGIMLSDDVCQLMLIRYGGPRLQMDFVSFIHLMLRVENMEDVFQNLTQDGKGIYLQKPEWMMMALYS

SEQ ID NO: 11149 - protein, 1086 aa, Homo sapiens
  Payload ID: 2202;
  Gene Symbol: CAPN15;
  Gene Name: calpain 15;
  Uniprot ID:  O75808;
  ENSP ID: ENSP00000219611
MATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVVPEVVAPAGFHVVPAAPPPGLPGEGAEANPPATSQGPAAEPEPPRVPPFSPFSSTLQNNPVPRSRREVPPQLQPPVPEAAQPSPSAGCRGAPQGSGWAGASRLAELLSGKRLSVLEEEATEGGTSRVEAGSSTSGSDIIDLAGDTVRYTPASPSSPDFTTWSCAKCTLRNPTVAPRCSACGCSKLHGFQEHGEPPTHCPDCGADKPSPCGRSCGRVSSAQKAARVLPERPGQWACPACTLLNALRAKHCAACHTPQLLVAQRRGAAPLRRRESMHVEQRRQTDEGEAKALWENIVAFCRENNVSFVDDSFPPGPESVGFPAGDSVQQRVRQWLRPQEINCSVFRDHRATWSVFHTLRPSDILQGLLGNCWFLSALAVLAERPDLVERVMVTRSLCAEGAYQVRLCKDGTWTTVLVDDMLPCDEAGCLLFSQAQRKQLWVALIEKALAKLHGSYFALQAGRAIEGLATLTGAPCESLALQLSSTNPREEPVDTDLIWAKMLSSKEAGFLMGASCGGGNMKVDDSAYESLGLRPRHAYSILDVRDVQGTRLLRLRNPWGRFSWNGSWSDEWPHWPGHLRGELMPHGSSEGVFWMEYGDFVRYFDSVDICKVHSDWQEARVQGCFPSSASAPVGVTALTVLERASLEFALFQEGSRRSDAVDSHLLDLCILVFRATFGSGGHLSLGRLLAHSKRAVKKFVSCDVMLEPGEYAVVCCAFNHWGPPLPGTPAPQASSPSAGVPRASPEPPGHVLAVYSSRLVMVEPVEAQPTTLADAIILLTESRGERHEGREGMTCYYLTHGWAGLIVVVENRHPKAYLHVQCDCTDSFNVVSTRGSLRTQDSVPPLHRQVLVILSQLEGNAGFSITHRLAHRKAAQAFLSDWTASKGTHSPPLTPEVAGLHGPRPL

SEQ ID NO: 11150 - protein, 184 aa, Homo sapiens
  Payload ID: 2202;
  Gene Symbol: CAPN15;
  Gene Name: calpain 15;
  ENSP ID: ENSP00000456017
MATVGEWSCVRCTFLNPAGQRQCSICEAPRHKPDLNHILRLSVEEQKWPCARCTFRNFLGKEACEVCGFTPEPAPGAAFLPVLNGVLPKPPAILGEPKGSCQEEAGPVRTAGLVATEPARGQCEDKDEEEKEEQEEEEGAAEPRGGWACPRCTLHNTPVASSCSVCGGPRRLSLPRIPPEALVV

SEQ ID NO: 11151 - protein, 112 aa, Homo sapiens
  Payload ID: 2202;
  Gene Symbol: CAPN15;
  Gene Name: calpain 15;
  ENSP ID: ENSP00000457030
MCQVHAQKPHSGPQVLGLRLLQTARLPGAWRAPHPLPRLWGRQAQPLRQKLRTGVLGPEGRPRPARAPGPVGLPCLYPAQRTAGQALRRLPHASAPGGPAAGGRAPEAQGEH

SEQ ID NO: 11152 - protein, 71 aa, Homo sapiens
  Payload ID: 2202;
  Gene Symbol: CAPN15;
  Gene Name: calpain 15;
  ENSP ID: ENSP00000457306
  MOD_RES (1)..(1): Any amino acid
XGERHEGREGMTCYYLTHGWAGLIVVVENRHPKAYLHVQCDCTDSFNVVSTRGSLRTQDSVPPLHSPVPLP

SEQ ID NO: 11153 - protein, 700 aa, Homo sapiens
  Payload ID: 2203;
  Gene Symbol: CAPN2;
  Gene Name: calpain 2, (m/II) large subunit;
  Uniprot ID:  P17655;
  ENSP ID: ENSP00000295006
MAGIAAKLAKDREAAEGLGSHDRAIKYLNQDYEALRNECLEAGTLFQDPSFPAIPSALGFKELGPYSSKTRGIEWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 11154 - protein, 131 aa, Homo sapiens
  Payload ID: 2203;
  Gene Symbol: CAPN2;
  Gene Name: calpain 2, (m/II) large subunit;
  ENSP ID: ENSP00000399949
MEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTG

SEQ ID NO: 11155 - protein, 622 aa, Homo sapiens
  Payload ID: 2203;
  Gene Symbol: CAPN2;
  Gene Name: calpain 2, (m/II) large subunit;
  Uniprot ID:  P17655;
  ENSP ID: ENSP00000413158
MEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGFRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 11156 - protein, 729 aa, Homo sapiens
  Payload ID: 2204;
  Gene Symbol: CAPN3;
  Gene Name: calpain 3;
  Uniprot ID:  P20807;
  ENSP ID: ENSP00000183936
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11157 - protein, 773 aa, Homo sapiens
  Payload ID: 2204;
  Gene Symbol: CAPN3;
  Gene Name: calpain 3;
  ENSP ID: ENSP00000326281
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11158 - protein, 156 aa, Homo sapiens
  Payload ID: 2204;
  Gene Symbol: CAPN3;
  Gene Name: calpain 3;
  Uniprot ID:  P20807;
  ENSP ID: ENSP00000336840
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11159 - protein, 156 aa, Homo sapiens; identical to SEQ ID NO: 11158
  Payload ID: 2204;
  Gene Symbol: CAPN3;
  Gene Name: calpain 3;
  Uniprot ID:  P20807;
  ENSP ID: ENSP00000348667

SEQ ID NO: 11160 - protein, 815 aa, Homo sapiens
  Payload ID: 2204;
  Gene Symbol: CAPN3;
  Gene Name: calpain 3;
  Uniprot ID:  P20807;
  ENSP ID: ENSP00000350181
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11161 - protein, 821 aa, Homo sapiens
  Payload ID: 2204;
  Gene Symbol: CAPN3;
  Gene Name: calpain 3;
  Uniprot ID:  P20807;
  ENSP ID: ENSP00000380349
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11162 - protein, 309 aa, Homo sapiens
  Payload ID: 2204;
  Gene Symbol: CAPN3;
  Gene Name: calpain 3;
  Uniprot ID:  P20807;
  ENSP ID: ENSP00000380384
MHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11163 - protein, 156 aa, Homo sapiens; identical to SEQ ID NO: 11158
  Payload ID: 2204;
  Gene Symbol: CAPN3;
  Gene Name: calpain 3;
  Uniprot ID:  P20807;
  ENSP ID: ENSP00000380387

SEQ ID NO: 11164 - protein, 255 aa, Homo sapiens
  Payload ID: 2204;
  Gene Symbol: CAPN3;
  Gene Name: calpain 3;
  ENSP ID: ENSP00000454379
MHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNV

SEQ ID NO: 11165 - protein, 67 aa, Homo sapiens
  Payload ID: 2204;
  Gene Symbol: CAPN3;
  Gene Name: calpain 3;
  ENSP ID: ENSP00000454937
  MOD_RES (1)..(1): Any amino acid
XFHLNNQLYDIITMRYADKHMNIDFDSFICCFVRLEGMFRAFHAFDKDGDGIIKLNVLEWLQLTMYA

SEQ ID NO: 11166 - protein, 156 aa, Homo sapiens; identical to SEQ ID NO: 11158
  Payload ID: 2204;
  Gene Symbol: CAPN3;
  Gene Name: calpain 3;
  Uniprot ID:  P20807;
  ENSP ID: ENSP00000455254

SEQ ID NO: 11167 - protein, 93 aa, Homo sapiens
  Payload ID: 2204;
  Gene Symbol: CAPN3;
  Gene Name: calpain 3;
  ENSP ID: ENSP00000456514
KIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 11168 - protein, 191 aa, Homo sapiens
  Payload ID: 2204;
  Gene Symbol: CAPN3;
  Gene Name: calpain 3;
  ENSP ID: ENSP00000456575
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEAVCRSTCRWHSAPPCARALHHLHAVPPWARNQTSTGFYCCGVN

SEQ ID NO: 11169 - protein, 188 aa, Homo sapiens
  Payload ID: 2204; Gene Symbol: CAPN3; Gene Name: calpain 3; ENSP ID: ENSP00000456607
  MOD_RES (1)..(1): Any amino acid
XGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQFSFVPPQPQPGSSDQESEEQQQFRNIFKQIAGDDMEICADELKKVLNTVVNKHKDLKTHGFTL

SEQ ID NO: 11170 - protein, 110 aa, Homo sapiens
  Payload ID: 2204
  Gene Symbol: CAPN3
  Gene Name: calpain 3
  ENSP ID: ENSP00000457759
KKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDP

SEQ ID NO: 11171 - protein, 157 aa, Homo sapiens
  Payload ID: 2204
  Gene Symbol: CAPN3
  Gene Name: calpain 3
  ENSP ID: ENSP00000457878
MGGVASTLQGLPMRLGYTGAGGFPGVCLEHLEPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLY

SEQ ID NO: 11172 - protein, 169 aa, Homo sapiens
  Payload ID: 2204
  Gene Symbol: CAPN3
  Gene Name: calpain 3
  ENSP ID: ENSP00000457898
  MOD_RES (1)..(1): Any amino acid
XSPQPQPGSSDQESEEQQQFRNIFKQIAGDDMEICADELKKVLNTVVNKHKDLKTHGFTLESCRSMIALMDTDGSGKLNLQEFHHLWNKIKAWQMRNAVNDAGFHLNNQLYDIITMRYADKHMNIDFDSFICCFVRLEGMFRAFHAFDKDGDGIIKLNVLEWLQLTMYA

SEQ ID NO: 11173 - protein, 640 aa, Homo sapiens
  Payload ID: 2205
  Gene Symbol: CAPN5
  Gene Name: calpain 5
  Uniprot ID: O15484
  ENSP ID: ENSP00000278559
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 11174 - protein, 680 aa, Homo sapiens
  Payload ID: 2205
  Gene Symbol: CAPN5
  Gene Name: calpain 5
  ENSP ID: ENSP00000409996
MFSCVKPYEDQNYSALRRDCRRRKVLFEDPLFPATDDSLYYKGTPGPAVRWKRPKYSGHSLAPHRPGWGDARRMENVPRPGSSGCPSSSLRARDLGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 11175 - protein, 640 aa, Homo sapiens; identical to SEQ ID NO: 11173
  Payload ID: 2205
  Gene Symbol: CAPN5
  Gene Name: calpain 5
  Uniprot ID: O15484
  ENSP ID: ENSP00000432332

SEQ ID NO: 11176 - protein, 97 aa, Homo sapiens
  Payload ID: 2205
  Gene Symbol: CAPN5
  Gene Name: calpain 5
  ENSP ID: ENSP00000435894
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLW

SEQ ID NO: 11177 - protein, 52 aa, Homo sapiens
  Payload ID: 2205
  Gene Symbol: CAPN5
  Gene Name: calpain 5
  ENSP ID: ENSP00000467244
MFSCVKPYEDQNYSALRRDCRRRKVLFEDPLFPATDDSLYYKGTPGPAVRCT

SEQ ID NO: 11178 - protein, 639 aa, Homo sapiens
  Payload ID: 2205
  Gene Symbol: CAPN5
  Gene Name: calpain 5
  ENSP ID: ENSP00000483282
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGMVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 11179 - protein, 641 aa, Homo sapiens
  Payload ID: 2206
  Gene Symbol: CAPN6
  Gene Name: calpain 6
  Uniprot ID: Q9Y6Q1
  ENSP ID: ENSP00000317214
MGPPLKLFKNQKYQELKQECIKDSRLFCDPTFLPENDSLFYNRLLPGKVVWKRPQDICDDPHLIVGNISNHQLTQGRLGHKPMVSAFSCLAVQESHWTKTIPNHKEQEWDPQKTEKYAGIFHFRFWHFGEWTEVVIDDLLPTINGDLVFSFSTSMNEFWNALLEKAYAKLLGCYEALDGLTITDIIVDFTGTLAETVDMQKGRYTELVEEKYKLFGELYKTFTKGGLICCSIESPNQEEQEVETDWGLLKGHTYTMTDIRKIRLGERLVEVFSAEKVYMVRLRNPLGRQEWSGPWSEISEEWQQLTASDRKNLGLVMSDDGEFWMSLEDFCRNFHKLNVCRNVNNPIFGRKELESVLGCWTVDDDPLMNRSGGCYNNRDTFLQNPQYIFTVPEDGHKVIMSLQQKDLRTYRRMGRPDNYIIGFELFKVEMNRKFRLHHLYIQERAGTSTYIDTRTVFLSKYLKKGNYVLVPTMFQHGRTSEFLLRIFSEVPVQLRELTLDMPKMSCWNLARGYPKVVTQITVHSAEDLEKKYANETVNPYLVIKCGKEEVRSPVQKNTVHAIFDTQAIFYRRTTDIPIIVQVWNSRKFCDQFLGQVTLDADPSDCRDLKSLYLRKKGGPTAKVKQGHISFKVISSDDLTEL

SEQ ID NO: 11180 - protein, 813 aa, Homo sapiens
  Payload ID: 2207
  Gene Symbol: CAPN7
  Gene Name: calpain 7
  Uniprot ID: Q9Y6W3
  ENSP ID: ENSP00000253693
MDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLITGIIYPQNKDGEPEYNPCGKYMVKLHLNGVPRKVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 11181 - protein, 42 aa, Homo sapiens
  Payload ID: 2207
  Gene Symbol: CAPN7
  Gene Name: calpain 7
  ENSP ID: ENSP00000389786
MDATALERDAVQFARLAVQRDHEGRYSEAVFYYKFSQRVLIL

SEQ ID NO: 11182 - protein, 112 aa, Homo sapiens
  Payload ID: 2207
  Gene Symbol: CAPN7
  Gene Name: calpain 7
  ENSP ID: ENSP00000394708
HLRWKGRYSENDVKNWTPELQKYLNFDPRTAQKIDNGIFWISWDDLCQYYDVIYLSWNPGLFKESTCIHRMILRIIENLSQWLYTRLMGKKFITQLTHLHTLMEFELTALII

SEQ ID NO: 11183 - protein, 248 aa, Homo sapiens
  Payload ID: 2207
  Gene Symbol: CAPN7
  Gene Name: calpain 7
  ENSP ID: ENSP00000399486
  MOD_RES (1)..(1): Any amino acid
XFSIKQTIVSDCSFVASLAISAAYERRFNKKLITGIIYPQNKDGEPEYNPCGKYMVKLHLNGVPRKNTYKLNISNLKIQNTPVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPR

SEQ ID NO: 11184 - protein, 36 aa, Homo sapiens
  Payload ID: 2207
  Gene Symbol: CAPN7
  Gene Name: calpain 7
  ENSP ID: ENSP00000415482
MDATALERDAVQFARLAVQRDHEGRYSEAVFYYKVQ

SEQ ID NO: 11185 - protein, 703 aa, Homo sapiens
  Payload ID: 2208
  Gene Symbol: CAPN8
  Gene Name: calpain 8
  Uniprot ID: A6NHC0
  ENSP ID: ENSP00000355837
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDAPEWNHIDPRRKEELDKKVEDGEFWMSLSDFVRQFSRLEICNLSPDSLSSEEVHKWNLVLFNGHWTRGSTAGGCQNYPATYWTNPQFKIRLDEVDEDQEESIGEPCCTVLLGLMQKNRRWRKRIGQGMLSIGYAVYQVPKELESHTDAHLGRDFFLAYQPSARTSTYVNLREVSGRARLPPGEYLVVPSTFEPFKDGEFCLRVFSEKKAQALEIGDVVAGNPYEPHPSEVDQEDDQFRRLFEKLAGKDSEITANALKILLNEAFSKRTDIKFDGFNINTCREMISLLDSNGTGTLGAVEFKTLWLKIQKYLEIYWETDYNHSGTIDAHEMRTALRKAGFTLNSQVQQTIALRYACSKLGINFDSFVACMIRLETLFKLFSLLDEDKDGMVQLSLAEWLCCVLV

SEQ ID NO: 11186 - protein, 381 aa, Homo sapiens
  Payload ID: 2208
  Gene Symbol: CAPN8
  Gene Name: calpain 8
  ENSP ID: ENSP00000355838
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDAPEWNHIDPRRKEELDKKVEDGEFWMSLSDFVRQFSRLEICNLSPDSLSSEEVHKWNLVLFNGHWTRGSTAGGCQNYPGSS

SEQ ID NO: 11187 - protein, 156 aa, Homo sapiens
  Payload ID: 2208
  Gene Symbol: CAPN8
  Gene Name: calpain 8
  ENSP ID: ENSP00000390294
DSEITANALKILLNEAFSKRTDIKFDGFNINTCREMISLLDSNGTGTLGAVEFKTLWLKIQKYLEIYWETDYNHSGTIDAHEMRTALRKAGFTLNSQVQQTIALRYACSKLGINFDSFVACMIRLETLFKLFSLLDEDKDGMVQLSLAEWLCCVLV

SEQ ID NO: 11188 - protein, 437 aa, Homo sapiens
  Payload ID: 2208
  Gene Symbol: CAPN8
  Gene Name: calpain 8
  ENSP ID: ENSP00000401665
MAAQAAGVSRQRAATQGLGSNQNALKYLGQDFKTLRQQCLDSGVLFKDPEFPACPSALGYKDLGPGSPQTQGIIWKRPTELCPSPQFIVGGATRTDICQGGLGDCWLLAAIASLTLNEELLYRVVPRDQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDDAPEWNHIDPRRKEELDKKVEDGEFWMSLSDFVRQFSRLEICNLSPDSLSSEEVHKWNLVLFNGHWTRGSTAGGCQNYPATYWTNPQFKIRLDEVDEDQEESIGEPCCTVLLGLMQKNRRWRKRIGQGMLSIGYAVYQ

SEQ ID NO: 11189 - protein, 101 aa, Homo sapiens
  Payload ID: 2208
  Gene Symbol: CAPN8
  Gene Name: calpain 8
  ENSP ID: ENSP00000409233
DSEITANALKILLNEAFSKRTDIKFDGFNINTCREMISLLDEETQDTMQVPDSSETFWNTEADILDTVRRWPSMNQEGGPHRHQICQCFDLGLLSLRNYEK

SEQ ID NO: 11190 - protein, 38 aa, Homo sapiens
  Payload ID: 2208
  Gene Symbol: CAPN8
  Gene Name: calpain 8
  ENSP ID: ENSP00000434013
ELCPSPQFIVGGATRTDICQGGLETRWMRIGLVGFRSN

SEQ ID NO: 11191 - protein, 173 aa, Homo sapiens
  Payload ID: 2208
  Gene Symbol: CAPN8
  Gene Name: calpain 8
  ENSP ID: ENSP00000435953
  MOD_RES (1)..(1): Any amino acid
XQDFQENYAGIFHFQFWQYGEWVEVVIDDRLPTKNGQLLFLHSEQGNEFWSALLEKAYAKLNGCYEALAGGSTVEGFEDFTGGISEFYDLKKPPANLYQIIRKALCAGSLLGCSIDVSSAAEAEAITSQKLVKSHAYSVTGVEEVNFQGHPEKLIRLRNPWGEVEWSGAWSDE

SEQ ID NO: 11192 - protein, 20 aa, Homo sapiens
  Payload ID: 2208
  Gene Symbol: CAPN8
  Gene Name: calpain 8
  ENSP ID: ENSP00000436371
  MOD_RES (1)..(1): Any amino acid
XLFSLLDEDKDGMVQLSLAE

SEQ ID NO: 11193 - protein, 690 aa, Homo sapiens
  Payload ID: 2209
  Gene Symbol: CAPN9
  Gene Name: calpain 9
  Uniprot ID: O14815
  ENSP ID: ENSP00000271971
MPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 11194 - protein, 664 aa, Homo sapiens
  Payload ID: 2209
  Gene Symbol: CAPN9
  Gene Name: calpain 9
  Uniprot ID: O14815
  ENSP ID: ENSP00000346538
MPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 11195 - protein, 627 aa, Homo sapiens
  Payload ID: 2209
  Gene Symbol: CAPN9
  Gene Name: calpain 9
  ENSP ID: ENSP00000355626
MPYLYRAPGPQAHPVPKDARITHSSGQSFEQMRQECLQRGTLFEDADFPASNSSLFYSERPQIPFVWKRPGFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 11196 - protein, 268 aa, Homo sapiens
  Payload ID: 2210
  Gene Symbol: CAPNS1
  Gene Name: calpain, small subunit 1
  Uniprot ID: P04632
  ENSP ID: ENSP00000246533
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQEWLQLTMYS

SEQ ID NO: 11197 - protein, 268 aa, Homo sapiens; identical to SEQ ID NO: 11196
  Payload ID: 2210
  Gene Symbol: CAPNS1
  Gene Name: calpain, small subunit 1
  Uniprot ID: P04632
  ENSP ID: ENSP00000464849

SEQ ID NO: 11198 - protein, 196 aa, Homo sapiens
  Payload ID: 2210
  Gene Symbol: CAPNS1
  Gene Name: calpain, small subunit 1
  ENSP ID: ENSP00000464903
  MOD_RES (1)..(1): Any amino acid
XTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAADESGNMDFDNFISCLVRLDAMFRAFKSLDKDGTGQIQVNIQEWLQLTMYS

SEQ ID NO: 11199 - protein, 238 aa, Homo sapiens
  Payload ID: 2210
  Gene Symbol: CAPNS1
  Gene Name: calpain, small subunit 1
  ENSP ID: ENSP00000465575
MFLVNSFLKGGGGGGGGGGGLGGGLGNVLGGLISGAGGGGGGGGGGGGGGGGGGGGTAMRILGGVISAISEAAAQYNPEPPDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQEWLQLTMYS

SEQ ID NO: 11200 - protein, 278 aa, Homo sapiens
  Payload ID: 2210
  Gene Symbol: CAPNS1
  Gene Name: calpain, small subunit 1
  ENSP ID: ENSP00000466113
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDLSLFLTPSHQSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQEWLQLTMYS

SEQ ID NO: 11201 - protein, 163 aa, Homo sapiens
  Payload ID: 2210
  Gene Symbol: CAPNS1
  Gene Name: calpain, small subunit 1
  ENSP ID: ENSP00000466386
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEE

SEQ ID NO: 11202 - protein, 94 aa, Homo sapiens
  Payload ID: 2210
  Gene Symbol: CAPNS1
  Gene Name: calpain, small subunit 1
  ENSP ID: ENSP00000466601
MFLVNSFLKGGGGGGGGGGGLGAFEAAGFHLNEHLYNMIIRRYSDESGNMDFDNFISCLVRLDAMFRAFKSLDKDGTGQIQVNIQEWLQLTMYS

SEQ ID NO: 11203 - protein, 322 aa, Homo sapiens
  Payload ID: 2210
  Gene Symbol: CAPNS1
  Gene Name: calpain, small subunit 1
  ENSP ID: ENSP00000468041
MFLVNSFLKGGGGGGGGGGGLGGGLGNVLGGLISGAGGGGGGGGGGGGGGGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLVRLDAMFRAFKSLDKDGTGQIQVNIQEVRTPILGYGCLGGPHPSALHTSSELQSPSSYFASRPWVRAKGLVLLGFPVLTLHPPLPSGCS

SEQ ID NO: 11204 - protein, 72 aa, Homo sapiens
  Payload ID: 2210
  Gene Symbol: CAPNS1
  Gene Name: calpain, small subunit 1
  ENSP ID: ENSP00000468591
MFLVNSFLKGGGGGGGGGGGLGGGLGNVLGGLISGAGGGGGGGGGGGGGGGGGGGGTAMRILGGVISAISEA

SEQ ID NO: 11205 - protein, 197 aa, Homo sapiens
  Payload ID: 2210
  Gene Symbol: CAPNS1
  Gene Name: calpain, small subunit 1
  ENSP ID: ENSP00000474036
GGGGGGGTAMRILGGVISAISEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNFISCLAQEEINMPQLLIS

SEQ ID NO: 11206 - protein, 54 aa, Homo sapiens
  Payload ID: 2210
  Gene Symbol: CAPNS1
  Gene Name: calpain, small subunit 1
  ENSP ID: ENSP00000474280
  MOD_RES (1)..(1): Any amino acid
XILGGVISAISEAAAQYNPEPPPPRTHYSNIEDTLTSSVHGSPHSHQALHTPTP

SEQ ID NO: 11207 - protein, 100 aa, Homo sapiens
  Payload ID: 2210
  Gene Symbol: CAPNS1
  Gene Name: calpain, small subunit 1
  ENSP ID: ENSP00000475159
MEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNM

SEQ ID NO: 11208 - protein, 161 aa, Homo sapiens
  Payload ID: 2210
  Gene Symbol: CAPNS1
  Gene Name: calpain, small subunit 1
  ENSP ID: ENSP00000475804
MGEAAAQYNPEPPPPRTHYSNIEANESEEVRQFRRLFAQLAGDDMEVSATELMNILNKVVTRHPDLKTDGFGIDTCRSMVAVMDSDTTGKLGFEEFKYLWNNIKRWQAIYKQFDTDRSGTICSSELPGAFEAAGFHLNEHLYNMIIRRYSDESGNMDFDNF

SEQ ID NO: 11209 - protein, 94 aa, Homo sapiens; identical to SEQ ID NO: 11202
  Payload ID: 2210
  Gene Symbol: CAPNS1
  Gene Name: calpain, small subunit 1
  ENSP ID: ENSP00000486032

SEQ ID NO: 11210 - protein, 238 aa, Homo sapiens; identical to SEQ ID NO: 11199
  Payload ID: 2210
  Gene Symbol: CAPNS1
  Gene Name: calpain, small subunit 1
  ENSP ID: ENSP00000486832

SEQ ID NO: 11211 - protein, 278 aa, Homo sapiens; identical to SEQ ID NO: 11200
  Payload ID: 2210
  Gene Symbol: CAPNS1
  Gene Name: calpain, small subunit 1
  ENSP ID: ENSP00000487115

SEQ ID NO: 11212 - protein, 248 aa, Homo sapiens
  Payload ID: 2211
  Gene Symbol: CAPNS2
  Gene Name: calpain, small subunit 2
  Uniprot ID: Q96L46
  ENSP ID: ENSP00000400882
MFLAKALLEGADRGLGEALGGLFGGGGQRREGGGRNIGGIVGGIVNFISEAAAAQYTPEPPPTQQHFTSVEASESEEVRRFRQQFTQLAGPDMEVGATDLMNILNKVLSKHKDLKTDGFSLDTCRSIVSVMDSDTTGKLGFEEFKYLWNNIKKWQCVYKQYDRDHSGSLGSSQLRGALQAAGFQLNEQLYQMIVRRYANEDGDMDFNNFISCLVRLDAMFRAFKSLDRDRDGLIQVSIKEWLQLTMYS

SEQ ID NO: 11213 - protein, 686 aa, Homo sapiens
  Payload ID: 2212
  Gene Symbol: CAST
  Gene Name: calpastatin
  Uniprot ID: P20810
  ENSP ID: ENSP00000312523
MNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11214 - protein, 430 aa, Homo sapiens
  Payload ID: 2212
  Gene Symbol: CAST
  Gene Name: calpastatin
  ENSP ID: ENSP00000320319
MGQFLSSTFLEGSPATVWHDKLCDGERRGAREAVRIFQDQAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11215 - protein, 708 aa, Homo sapiens
  Payload ID: 2212
  Gene Symbol: CAST
  Gene Name: calpastatin
  Uniprot ID: P20810
  ENSP ID: ENSP00000339914
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11216 - protein, 695 aa, Homo sapiens
  Payload ID: 2212
  Gene Symbol: CAST
  Gene Name: calpastatin
  Uniprot ID: P20810
  ENSP ID: ENSP00000343421
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11217 - protein, 750 aa, Homo sapiens
  Payload ID: 2212
  Gene Symbol: CAST
  Gene Name: calpastatin
  Uniprot ID: P20810
  ENSP ID: ENSP00000379157
MSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11218 - protein, 708 aa, Homo sapiens; identical to SEQ ID NO: 11215
  Payload ID: 2212
  Gene Symbol: CAST
  Gene Name: calpastatin
  Uniprot ID: P20810
  ENSP ID: ENSP00000379158

SEQ ID NO: 11219 - protein, 304 aa, Homo sapiens
  Payload ID: 2212
  Gene Symbol: CAST
  Gene Name: calpastatin
  ENSP ID: ENSP00000396558
MSQPGQKPAASPRPRRAAAARRTHEHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFT

SEQ ID NO: 11220 - protein, 436 aa, Homo sapiens
  Payload ID: 2212
  Gene Symbol: CAST
  Gene Name: calpastatin
  ENSP ID: ENSP00000412374
  MOD_RES (1)..(1): Any amino acid
XKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKTTEETSKPKDD

SEQ ID NO: 11221 - protein, 693 aa, Homo sapiens
  Payload ID: 2212
  Gene Symbol: CAST
  Gene Name: calpastatin
  ENSP ID: ENSP00000421130
MEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11222 - protein, 149 aa, Homo sapiens
  Payload ID: 2212
  Gene Symbol: CAST
  Gene Name: calpastatin
  ENSP ID: ENSP00000421230
MAFASWWYKTHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKPKSLPKQASDTGSNDAHNKKAVSRSAEQQPSEKSTEPK

SEQ ID NO: 11223 - protein, 769 aa, Homo sapiens
  Payload ID: 2212
  Gene Symbol: CAST
  Gene Name: calpastatin
  Uniprot ID: P20810
  ENSP ID: ENSP00000422176
MSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11224 - protein, 642 aa, Homo sapiens
  Payload ID: 2212
  Gene Symbol: CAST
  Gene Name: calpastatin
  ENSP ID: ENSP00000422325
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSK

SEQ ID NO: 11225 - protein, 82 aa, Homo sapiens
  Payload ID: 2212
  Gene Symbol: CAST
  Gene Name: calpastatin
  ENSP ID: ENSP00000422466
MNPTETKAIPVSQQMEGPHLPNKKKHKKQAVKTEPEKKSQSTKLSVVHEKKSQEGKPKEHTEAPVCVLSAKKPTQAGIRYRK

SEQ ID NO: 11226 - protein, 150 aa, Homo sapiens
  Payload ID: 2212
  Gene Symbol: CAST
  Gene Name: calpastatin
  ENSP ID: ENSP00000422612
MAFASWWYKTHVSEKTSESPSKPGEKKGSDEKKAASLGSSQSSRTYAGGTASATKVSASSGATSKSSSMNPTETKAVKTEPEKKSQSTKPKSLPKQASDTGSNDAHNKKAVSRSAEQQPSEKSTEPKTKPQDMISAGGESVAGITAISGK

SEQ ID NO: 11227 - protein, 754 aa, Homo sapiens
  Payload ID: 2212
  Gene Symbol: CAST
  Gene Name: calpastatin
  ENSP ID: ENSP00000422677
MAFASWWYKTHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11228 - protein, 78 aa, Homo sapiens
  Payload ID: 2212
  Gene Symbol: CAST
  Gene Name: calpastatin
  ENSP ID: ENSP00000422807
MSDQALEALSASLGTRQAEPELDLRSIKEVDEAKAKEEKLEKCGEDDETIPSEYRLKPATDKDGKPLLPEPEEKPKVR

SEQ ID NO: 11229 - protein, 156 aa, Homo sapiens
  Payload ID: 2212
  Gene Symbol: CAST
  Gene Name: calpastatin
  ENSP ID: ENSP00000422831
MNPTETKAVKTEPEKKSQSTKLSVVHEKKSQEGKPKEHTEPKSLPKQASDTGSNDAHNKKAVSRSAEQQPSEKSTEPKKKEKKSLTPAVPVESKPDKPSGKSGMDAALDDLIDTLGGPEETEEENTTYTGPEVSDPMSSTYIEELGKREVTIPPKY

SEQ ID NO: 11230 - protein, 431 aa, Homo sapiens
  Payload ID: 2212
  Gene Symbol: CAST
  Gene Name: calpastatin
  ENSP ID: ENSP00000422929
MGQFLSSTFLEGSPATVWHDKLCDGERRGAREAVRIFQDQAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11231 - protein, 393 aa, Homo sapiens
  Payload ID: 2212
  Gene Symbol: CAST
  Gene Name: calpastatin
  ENSP ID: ENSP00000422951
MSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPAT

SEQ ID NO: 11232 - protein, 288 aa, Homo sapiens
  Payload ID: 2212
  Gene Symbol: CAST
  Gene Name: calpastatin
  ENSP ID: ENSP00000422957
GEVPSAMIVSFLRPSQPFRTHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLA

SEQ ID NO: 11233 - protein, 694 aa, Homo sapiens
  Payload ID: 2212
  Gene Symbol: CAST
  Gene Name: calpastatin
  ENSP ID: ENSP00000423638
MEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11234 - protein, 91 aa, Homo sapiens
  Payload ID: 2212
  Gene Symbol: CAST
  Gene Name: calpastatin
  ENSP ID: ENSP00000423846
MSDQALEALSASLGTRQAEPELDLRSIKEVDEDKDGKPLLPEPEEKPKPRSESELIDELSEDFDRSECKEKPSKPTEKTEESKAAAPAPVS

SEQ ID NO: 11235 - protein, 465 aa, Homo sapiens
  Payload ID: 2212
  Gene Symbol: CAST
  Gene Name: calpastatin
  ENSP ID: ENSP00000424160
  MOD_RES (1)..(1): Any amino acid
XPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11236 - protein, 636 aa, Homo sapiens
  Payload ID: 2212
  Gene Symbol: CAST
  Gene Name: calpastatin
  ENSP ID: ENSP00000425670
MNPTETKAVKTEPEKKSQSTKLSVVHEKKSQEGKPKEHTEPKSLPKQASDTGSNDAHNKKAVSRSAEQQPSEKSTEPKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11237 - protein, 791 aa, Homo sapiens
  Payload ID: 2212
  Gene Symbol: CAST
  Gene Name: calpastatin
  Uniprot ID: P20810
  ENSP ID: ENSP00000425721
MSQPGQKPAASPRPRRAAAARRTHEHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11238 - protein, 423 aa, Homo sapiens
  Payload ID: 2212
  Gene Symbol: CAST
  Gene Name: calpastatin
  ENSP ID: ENSP00000425787
MSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11239 - protein, 301 aa, Homo sapiens
  Payload ID: 2212
  Gene Symbol: CAST
  Gene Name: calpastatin
  ENSP ID: ENSP00000426422
  MOD_RES (1)..(1): Any amino acid
XAARRTHEHVSEKTSESPSKPGEKKGSDEKKAASLGSSQSSRTYAGGTASATKVSASSGATSKSSSMNPTETKAVKTEPEKKSQSTKLSVVHEKKSQEGKPKEHTEPKSLPKQASDTGSNDAHNKKAVSRSAEQQPSEKSTEPKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKV

SEQ ID NO: 11240 - protein, 673 aa, Homo sapiens
  Payload ID: 2212
  Gene Symbol: CAST
  Gene Name: calpastatin
  ENSP ID: ENSP00000426946
MNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11241 - protein, 156 aa, Homo sapiens
  Payload ID: 2212
  Gene Symbol: CAST
  Gene Name: calpastatin
  ENSP ID: ENSP00000427092
MAFASWWYKTHVSEKTSESPSKPGEKKGSDEKKAASLGSSQSSRTYAGGTASATKVSASSGATSKSSSMNPTETKAIPVSQQMEGPHLPNKKKHKKQAVKTEPEKKSQSTKLSVVHEKKSQEGKPKEHTEPKSLPKQASDTGSNDAHNKKAVSRSA

SEQ ID NO: 11242 - protein, 203 aa, Homo sapiens
  Payload ID: 2212
  Gene Symbol: CAST
  Gene Name: calpastatin
  ENSP ID: ENSP00000427195
MSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11243 - protein, 450 aa, Homo sapiens
  Payload ID: 2212
  Gene Symbol: CAST
  Gene Name: calpastatin
  ENSP ID: ENSP00000432878
  MOD_RES (1)..(1): Any amino acid
XGSLPDFQQQSLSLGLPWPKMGQFLSSTFLEGSPATVWHDKLCDGERRGAREAVRIFQDQAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 11244 - protein, 297 aa, Homo sapiens
  Payload ID: 2213
  Gene Symbol: CNN1
  Gene Name: calponin 1, basic, smooth muscle
  Uniprot ID: P51911
  ENSP ID: ENSP00000252456
MSSAHFNRGPAYGLSAEVKNKLAQKYDHQREQELREWIEGVTGRRIGNNFMDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 11245 - protein, 247 aa, Homo sapiens
  Payload ID: 2213
  Gene Symbol: CNN1
  Gene Name: calponin 1, basic, smooth muscle
  ENSP ID: ENSP00000442031
MDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 11246 - protein, 116 aa, Homo sapiens
  Payload ID: 2213
  Gene Symbol: CNN1
  Gene Name: calponin 1, basic, smooth muscle
  ENSP ID: ENSP00000466886
MDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGL

SEQ ID NO: 11247 - protein, 173 aa, Homo sapiens
  Payload ID: 2213
  Gene Symbol: CNN1
  Gene Name: calponin 1, basic, smooth muscle
  ENSP ID: ENSP00000467701
  MOD_RES (1)..(1): Any amino acid
XKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQVSGGPRDTPSRPRTLATPRPDHTTLRRLA

SEQ ID NO: 11248 - protein, 228 aa, Homo sapiens
  Payload ID: 2213
  Gene Symbol: CNN1
  Gene Name: calponin 1, basic, smooth muscle
  ENSP ID: ENSP00000468053
  MOD_RES (1)..(1): Any amino acid
XEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELAPKGRTEQRYSSCPPTPSQVGTPRTRSSPSKAPRAQARPAPTPFPQWEQTACPETQRTHAVWFAATGILCGCDSGVCNESTFFFFYFTGAQ

SEQ ID NO: 11249 - protein, 247 aa, Homo sapiens; identical to SEQ ID NO: 11245
  Payload ID: 2213
  Gene Symbol: CNN1
  Gene Name: calponin 1, basic, smooth muscle
  ENSP ID: ENSP00000468259

SEQ ID NO: 11250 - protein, 175 aa, Homo sapiens
  Payload ID: 2213
  Gene Symbol: CNN1
  Gene Name: calponin 1, basic, smooth muscle
  ENSP ID: ENSP00000468293
  MOD_RES (1)..(1): Any amino acid
XFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQAGMTAPGTKRQIFEPGLGMEHCDTLNVSLQMGSNKGASQRGMTVYGLPRQVYDPKYCLTPEYPELGEPA

SEQ ID NO: 11251 - protein, 119 aa, Homo sapiens
  Payload ID: 2213
  Gene Symbol: CNN1
  Gene Name: calponin 1, basic, smooth muscle
  ENSP ID: ENSP00000468326
MGTQDWAKKRQRWGRERQRSRGDKRERDIQTCKGWGLRQRQAPTTNQRQSPGAEDLGDTERQRCMTSTPLQASTQGHLLRHPSSLPELAQKYDHQREQELREWIEGVTGRRIGNNFMDG

SEQ ID NO: 11252 - protein, 115 aa, Homo sapiens
  Payload ID: 2213
  Gene Symbol: CNN1
  Gene Name: calponin 1, basic, smooth muscle
  ENSP ID: ENSP00000468737
LCEFINKLQPGSVKKINESTQNWHQLENIGNFIKAITKYGVKPHDIFEPGLGMEHCDTLNVSLQMGSNKGASQRGMTVYGLPRQVYDPKYCLTPEYPELGEPAHNHHAHNYYNSA

SEQ ID NO: 11253 - protein, 309 aa, Homo sapiens
  Payload ID: 2214
  Gene Symbol: CNN2
  Gene Name: calponin 2
  Uniprot ID: Q99439
  ENSP ID: ENSP00000263097
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 11254 - protein, 270 aa, Homo sapiens
  Payload ID: 2214
  Gene Symbol: CNN2
  Gene Name: calponin 2
  Uniprot ID: Q99439
  ENSP ID: ENSP00000340129
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 11255 - protein, 154 aa, Homo sapiens
  Payload ID: 2214
  Gene Symbol: CNN2
  Gene Name: calponin 2
  ENSP ID: ENSP00000455777
MNKLQPGSVPKINRSMQNWHQLENLSNFIKAMVSYGMNPVDLFEANDLFESGNMTQVQVSLLALAGKMGTNKCASQSGMTAYGTRRHLYDPKNHILPPMDHSTISLQMGTNKCASQVGLARVPPTPLPAPLHPVVSAPPWGHLQLLSPLSVSAP

SEQ ID NO: 11256 - protein, 330 aa, Homo sapiens
  Payload ID: 2214
  Gene Symbol: CNN2
  Gene Name: calponin 2
  ENSP ID: ENSP00000456436
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKGLDLGSLAALCWYSRPLSLTQAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 11257 - protein, 298 aa, Homo sapiens
  Payload ID: 2214
  Gene Symbol: CNN2
  Gene Name: calponin 2
  ENSP ID: ENSP00000457968
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 11258 - protein, 218 aa, Homo sapiens
  Payload ID: 2214
  Gene Symbol: CNN2
  Gene Name: calponin 2
  ENSP ID: ENSP00000458137
LSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQDLTLLSRLECSGTISAHCNLCLPGSRDSPSCLSLPSSWDYRWA

SEQ ID NO: 11259 - protein, 148 aa, Homo sapiens
  Payload ID: 2214
  Gene Symbol: CNN2
  Gene Name: calponin 2
  ENSP ID: ENSP00000468577
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKVRPREGQPPAQSHTARWM

SEQ ID NO: 11260 - protein, 103 aa, Homo sapiens
  Payload ID: 2214
  Gene Symbol: CNN2
  Gene Name: calponin 2
  ENSP ID: ENSP00000475175
  MOD_RES (1)..(1): Any amino acid
XSYGLSAEVKNRMGTNKCASQSGMTAYGTRRHLYDPKNHILPPMDHSTISLQMGTNKCASQVGLARVPPTPLPAPLHPVVSAPPWGHLQLLSPLSVSAPSLDH

SEQ ID NO: 11261 - protein, 66 aa, Homo sapiens
  Payload ID: 2214
  Gene Symbol: CNN2
  Gene Name: calponin 2
  ENSP ID: ENSP00000479188
MNKLQPGSVPKINRSMQNWHQLENLSNFIKAMVSYGMNPVDLFEANDLFESGNMTQVQVSLLALAG

SEQ ID NO: 11262 - protein, 191 aa, Homo sapiens
  Payload ID: 2214
  Gene Symbol: CNN2
  Gene Name: calponin 2
  ENSP ID: ENSP00000484533
MNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQG

SEQ ID NO: 11263 - protein, 179 aa, Homo sapiens
  Payload ID: 2214
  Gene Symbol: CNN2
  Gene Name: calponin 2
  ENSP ID: ENSP00000484749
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQAKTKGLQSGVDIGVKYSEKQERNFDDATMKAGQCVIGLQMGTNKCASQSGMTAYGTRR

SEQ ID NO: 11264 - protein, 329 aa, Homo sapiens
  Payload ID: 2215
  Gene Symbol: CNN3
  Gene Name: calponin 3, acidic
  Uniprot ID: Q15417
  ENSP ID: ENSP00000359225
MTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 11265 - protein, 283 aa, Homo sapiens
  Payload ID: 2215
  Gene Symbol: CNN3
  Gene Name: calponin 3, acidic
  Uniprot ID: Q15417
  ENSP ID: ENSP00000377752
MTHFNKGPSYGLSAEVKNKIASKYDHQAEEDLRNWIEEVTGMSIGPNFQLGLKDGIILCELINKLQPGSVKKVNESSLNWPQAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 11266 - protein, 185 aa, Homo sapiens
  Payload ID: 2215
  Gene Symbol: CNN3
  Gene Name: calponin 3, acidic
  ENSP ID: ENSP00000401452
MSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRR

SEQ ID NO: 11267 - protein, 288 aa, Homo sapiens
  Payload ID: 2215
  Gene Symbol: CNN3
  Gene Name: calponin 3, acidic
  Uniprot ID: Q15417
  ENSP ID: ENSP00000440081
MSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 11268 - protein, 417 aa, Homo sapiens
  Payload ID: 2216
  Gene Symbol: CALR
  Gene Name: calreticulin
  Uniprot ID: P27797
  ENSP ID: ENSP00000320866
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 11269 - protein, 247 aa, Homo sapiens
  Payload ID: 2216
  Gene Symbol: CALR
  Gene Name: calreticulin
  ENSP ID: ENSP00000465105
MLLSVPLLLGLLGLAVAEPAVYFKEQFLDGDGWTSRWIESKHKSDFGKFVLSSGKFYGDEEKDKGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLG

SEQ ID NO: 11270 - protein, 163 aa, Homo sapiens
  Payload ID: 2216
  Gene Symbol: CALR
  Gene Name: calreticulin
  ENSP ID: ENSP00000465918
  MOD_RES (1)..(1): Any amino acid
XEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRPERSCRRAGRAK

SEQ ID NO: 11271 - protein, 13 aa, Homo sapiens
  Payload ID: 2216
  Gene Symbol: CALR
  Gene Name: calreticulin
  ENSP ID: ENSP00000466037
  MOD_RES (1)..(1): Any amino acid
XEEDVPGQAKDEL

SEQ ID NO: 11272 - protein, 384 aa, Homo sapiens
  Payload ID: 2217
  Gene Symbol: CALR3
  Gene Name: calreticulin 3
  Uniprot ID: Q96L12
  ENSP ID: ENSP00000269881
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 11273 - protein, 142 aa, Homo sapiens
  Payload ID: 2217
  Gene Symbol: CALR3
  Gene Name: calreticulin 3
  ENSP ID: ENSP00000471533
  MOD_RES (1)..(1): Any amino acid
XLVQLWAICMLRVALATVYFQEEFLDGEHWRNRWLQSTNDSRFGHFRLSSGKFYGHKEKDKGPDICGFDIKKVHVILHFKNKYHENKKLIRCKVDGFTHLYTLILRPDLSYDVKIDGQSIESGSIEYDWNLTSLKKETSPAE

SEQ ID NO: 11274 - protein, 396 aa, Homo sapiens
  Payload ID: 2218
  Gene Symbol: CASQ1
  Gene Name: calsequestrin 1 (fast-twitch, skeletal muscle)
  Uniprot ID: P31415
  ENSP ID: ENSP00000357057
MSATDRMGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 11275 - protein, 117 aa, Homo sapiens
  Payload ID: 2218
  Gene Symbol: CASQ1
  Gene Name: calsequestrin 1 (fast-twitch, skeletal muscle)
  ENSP ID: ENSP00000418051
MDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 11276 - protein, 399 aa, Homo sapiens
  Payload ID: 2219
  Gene Symbol: CASQ2
  Gene Name: calsequestrin 2 (cardiac muscle)
  Uniprot ID: O14958
  ENSP ID: ENSP00000261448
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 11277 - protein, 971 aa, Homo sapiens
  Payload ID: 2220
  Gene Symbol: CLSTN1
  Gene Name: calsyntenin 1
  Uniprot ID: O94985
  ENSP ID: ENSP00000354997
MLRRPAPALAPAARLLLAGLLCGGGVWAARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 11278 - protein, 981 aa, Homo sapiens
  Payload ID: 2220
  Gene Symbol: CLSTN1
  Gene Name: calsyntenin 1
  Uniprot ID: O94985
  ENSP ID: ENSP00000366513
MLRRPAPALAPAARLLLAGLLCGGGVWAARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 11279 - protein, 782 aa, Homo sapiens
  Payload ID: 2220
  Gene Symbol: CLSTN1
  Gene Name: calsyntenin 1
  ENSP ID: ENSP00000401934
SILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 11280 - protein, 955 aa, Homo sapiens
  Payload ID: 2221
  Gene Symbol: CLSTN2
  Gene Name: calsyntenin 2
  Uniprot ID: Q9H4D0
  ENSP ID: ENSP00000402460
MLPGRLCWVPLLLALGVGSGSGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPSIATVVIIISVCMLVFVVAMGVYRVRIAHQHFIQETEAAKESEMDWDDSALTITVNPMEKHEGPGHGEDETEGEEEEEAEEEMSSSSGSDDSEEEEEEEGMGRGRHGQNGARQAQLEWDDSTLPY

SEQ ID NO: 11281 - protein, 891 aa, Homo sapiens
  Payload ID: 2221
  Gene Symbol: CLSTN2
  Gene Name: calsyntenin 2
  ENSP ID: ENSP00000478883
LASQDSHSLFPSAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPSIATVVIIISVCMLVFVVAMGVYRVRIAHQHFIQETEAAKESEMDWDDSALTITVNPMEKHEGPGHGEDETEGEEEEEAEEEMSSSSGSDDSEEEEEEEGMGRGRHGQNGARQAQLEWDDSTLPY

SEQ ID NO: 11282 - protein, 956 aa, Homo sapiens
  Payload ID: 2222
  Gene Symbol: CLSTN3
  Gene Name: calsyntenin 3
  Uniprot ID: Q9BQT9
  ENSP ID: ENSP00000266546
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 11283 - protein, 968 aa, Homo sapiens
  Payload ID: 2222
  Gene Symbol: CLSTN3
  Gene Name: calsyntenin 3
  Uniprot ID: Q9BQT9
  ENSP ID: ENSP00000440679
MVLGCELSGSTRVVVGVEALLTGASSPLPGVGPANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 11284 - protein, 142 aa, Homo sapiens
  Payload ID: 2222
  Gene Symbol: CLSTN3
  Gene Name: calsyntenin 3
  ENSP ID: ENSP00000442612
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQ

SEQ ID NO: 11285 - protein, 176 aa, Homo sapiens
  Payload ID: 2222
  Gene Symbol: CLSTN3
  Gene Name: calsyntenin 3
  ENSP ID: ENSP00000442801
MVVITNKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFL

SEQ ID NO: 11286 - protein, 129 aa, Homo sapiens
  Payload ID: 2222
  Gene Symbol: CLSTN3
  Gene Name: calsyntenin 3
  ENSP ID: ENSP00000443468
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRV

SEQ ID NO: 11287 - protein, 154 aa, Homo sapiens
  Payload ID: 2222
  Gene Symbol: CLSTN3
  Gene Name: calsyntenin 3
  ENSP ID: ENSP00000443490
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTP

SEQ ID NO: 11288 - protein, 134 aa, Homo sapiens
  Payload ID: 2222
  Gene Symbol: CLSTN3
  Gene Name: calsyntenin 3
  ENSP ID: ENSP00000443959
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVR

SEQ ID NO: 11289 - protein, 315 aa, Homo sapiens
  Payload ID: 2223
  Gene Symbol: CALU
  Gene Name: calumenin
  Uniprot ID: O43852
  ENSP ID: ENSP00000249364
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 11290 - protein, 315 aa, Homo sapiens
  Payload ID: 2223
  Gene Symbol: CALU
  Gene Name: calumenin
  Uniprot ID: O43852
  ENSP ID: ENSP00000408838
MDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 11291 - protein, 147 aa, Homo sapiens
  Payload ID: 2223
  Gene Symbol: CALU
  Gene Name: calumenin
  ENSP ID: ENSP00000417973
  MOD_RES (1)..(1): Any amino acid
XIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 11292 - protein, 323 aa, Homo sapiens
  Payload ID: 2223
  Gene Symbol: CALU
  Gene Name: calumenin
  Uniprot ID: O43852
  ENSP ID: ENSP00000420381
MKETDLIIMDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 11293 - protein, 323 aa, Homo sapiens
  Payload ID: 2223
  Gene Symbol: CALU
  Gene Name: calumenin
  Uniprot ID: O43852
  ENSP ID: ENSP00000438248
MKETDLIIMDLRQFLMCLSLCTAFALSKPTEKKDRVHHEPQLSDKVHNDAQSFDYDHDAFLGAEEAKTFDQLTPEESKERLGMIVDKIDADKDGFVTEGELKSWIKHAQKKYIYDNVENQWQEFDMNQDGLISWDEYRNVTYGTYLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 11294 - protein, 224 aa, Homo sapiens
  Payload ID: 2223
  Gene Symbol: CALU
  Gene Name: calumenin
  Uniprot ID: O43852
  ENSP ID: ENSP00000442110
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGWQAYQGGDR

SEQ ID NO: 11295 - protein, 473 aa, Homo sapiens
  Payload ID: 2224
  Gene Symbol: CAMKV
  Gene Name: CaM kinase-like vesicle-associated
  Uniprot ID: Q8NCB2
  ENSP ID: ENSP00000296471
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 11296 - protein, 434 aa, Homo sapiens
  Payload ID: 2224
  Gene Symbol: CAMKV
  Gene Name: CaM kinase-like vesicle-associated
  ENSP ID: ENSP00000417614
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKTVVPPQPQMEVPPQPLMAVSPQPPMEASLQPLMGVSPQPLTGALLQPLMGEPHQPQKRALCPPPKAVPCWPPRQLPPLSRLWPSRTAQPQRAPQARLHPLVKGKRLLVMPRSLKGRRPAE

SEQ ID NO: 11297 - protein, 470 aa, Homo sapiens
  Payload ID: 2224
  Gene Symbol: CAMKV
  Gene Name: CaM kinase-like vesicle-associated
  Uniprot ID: Q8NCB2
  ENSP ID: ENSP00000418809
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 11298 - protein, 501 aa, Homo sapiens
  Payload ID: 2224
  Gene Symbol: CAMKV
  Gene Name: CaM kinase-like vesicle-associated
  Uniprot ID: Q8NCB2
  ENSP ID: ENSP00000419195
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 11299 - protein, 123 aa, Homo sapiens
  Payload ID: 2224
  Gene Symbol: CAMKV
  Gene Name: CaM kinase-like vesicle-associated
  ENSP ID: ENSP00000420000
MPFGCVTLGDKKNYNQPSEVFDWILDQGYYSERDTSNVVRQVLEAVAYLHSLKIVHRNLKLENLVYYNRLKNSKIVISDFHLAKLENGLIKEPCGTPDPRGGRPAAVWTPCGLLGHWSHHVHP

SEQ ID NO: 11300 - protein, 426 aa, Homo sapiens
  Payload ID: 2224
  Gene Symbol: CAMKV
  Gene Name: CaM kinase-like vesicle-associated
  ENSP ID: ENSP00000420053
MVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 11301 - protein, 94 aa, Homo sapiens
  Payload ID: 2224
  Gene Symbol: CAMKV
  Gene Name: CaM kinase-like vesicle-associated
  ENSP ID: ENSP00000420139
MPFGCVTLGDKKNYNQPSEVTDRYDLGQVIKTEEFCEIFRAKDKTTGKLHTCKKFQKRDGRKGEASQHPTAGGCVCDPQGVLYLPGAGHGEGGV

SEQ ID NO: 11302 - protein, 427 aa, Homo sapiens
  Payload ID: 2224
  Gene Symbol: CAMKV
  Gene Name: CaM kinase-like vesicle-associated
  ENSP ID: ENSP00000420724
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 11303 - protein, 143 aa, Homo sapiens
  Payload ID: 2224
  Gene Symbol: CAMKV
  Gene Name: CaM kinase-like vesicle-associated
  ENSP ID: ENSP00000420766
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATTRSETQATWYGKSWRPWPICTHSRSCTGISSWRTWFTTTG

SEQ ID NO: 11304 - protein, 473 aa, Homo sapiens; identical to SEQ ID NO: 11295
  Payload ID: 2224
  Gene Symbol: CAMKV
  Gene Name: CaM kinase-like vesicle-associated
  Uniprot ID: Q8NCB2
  ENSP ID: ENSP00000484045

SEQ ID NO: 11305 - protein, 327 aa, Homo sapiens
  Payload ID: 2225
  Gene Symbol: CREB1
  Gene Name: cAMP responsive element binding protein 1
  Uniprot ID: P16220
  ENSP ID: ENSP00000236995
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 11306 - protein, 341 aa, Homo sapiens
  Payload ID: 2225
  Gene Symbol: CREB1
  Gene Name: cAMP responsive element binding protein 1
  Uniprot ID: P16220
  ENSP ID: ENSP00000387699
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 11307 - protein, 131 aa, Homo sapiens
  Payload ID: 2225
  Gene Symbol: CREB1
  Gene Name: cAMP responsive element binding protein 1
  ENSP ID: ENSP00000391125
MPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVP

SEQ ID NO: 11308 - protein, 132 aa, Homo sapiens
  Payload ID: 2225
  Gene Symbol: CREB1
  Gene Name: cAMP responsive element binding protein 1
  ENSP ID: ENSP00000392428
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRP

SEQ ID NO: 11309 - protein, 140 aa, Homo sapiens
  Payload ID: 2225
  Gene Symbol: CREB1
  Gene Name: cAMP responsive element binding protein 1
  ENSP ID: ENSP00000401803
GGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNRYKYCIYLDCYVLSVSSHSAGCVSLHLLVIGSLH

SEQ ID NO: 11310 - protein, 170 aa, Homo sapiens
  Payload ID: 2225
  Gene Symbol: CREB1
  Gene Name: cAMP responsive element binding protein 1
  ENSP ID: ENSP00000403678
MPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYTASGDVQTYQIRTAPTSTIAPGVVMASSPALPTQPAEEAARK

SEQ ID NO: 11311 - protein, 79 aa, Homo sapiens
  Payload ID: 2225
  Gene Symbol: CREB1
  Gene Name: cAMP responsive element binding protein 1
  ENSP ID: ENSP00000404890
MTMESGAENQQSGDAAVTEAENQQMTVQAQPQIATLAQVSMPAAHATSSAPTVTLVQLPNGQTVQVHGVIQAAQPSVIQ

SEQ ID NO: 11312 - protein, 327 aa, Homo sapiens; identical to SEQ ID NO: 11305
  Payload ID: 2225
  Gene Symbol: CREB1
  Gene Name: cAMP responsive element binding protein 1
  Uniprot ID: P16220
  ENSP ID: ENSP00000405539

SEQ ID NO: 11313 - protein, 251 aa, Homo sapiens
  Payload ID: 2225
  Gene Symbol: CREB1
  Gene Name: cAMP responsive element binding protein 1
  ENSP ID: ENSP00000405711
MPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKK

SEQ ID NO: 11314 - protein, 182 aa, Homo sapiens
  Payload ID: 2225
  Gene Symbol: CREB1
  Gene Name: cAMP responsive element binding protein 1
  ENSP ID: ENSP00000407227
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQY

SEQ ID NO: 11315 - protein, 181 aa, Homo sapiens
  Payload ID: 2225
  Gene Symbol: CREB1
  Gene Name: cAMP responsive element binding protein 1
  ENSP ID: ENSP00000412016
  MOD_RES (1)..(1): Any amino acid
XVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQGTQKL

SEQ ID NO: 11316 - protein, 371 aa, Homo sapiens
  Payload ID: 2226
  Gene Symbol: CREB3
  Gene Name: cAMP responsive element binding protein 3
  Uniprot ID: O43889
  ENSP ID: ENSP00000342136
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 11317 - protein, 394 aa, Homo sapiens
  Payload ID: 2226
  Gene Symbol: CREB3
  Gene Name: cAMP responsive element binding protein 3
  ENSP ID: ENSP00000484327
MELELDAGDQDLLAFLLEESGDLGTAPDEAVRAPLDWALPLSEVPSDWEVDDLLCSLLSPPASLNILSSSNPCLVHHDHTYSLPRETVSMDLGESEISLGRTGFMGLAIHTFPFAESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 11318 - protein, 105 aa, Homo sapiens
  Payload ID: 2227
  Gene Symbol: CREB3L1
  Gene Name: cAMP responsive element binding protein 3-like 1
  ENSP ID: ENSP00000431677
MEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAA

SEQ ID NO: 11319 - protein, 123 aa, Homo sapiens
  Payload ID: 2227
  Gene Symbol: CREB3L1
  Gene Name: cAMP responsive element binding protein 3-like 1
  ENSP ID: ENSP00000436574
ISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANSFSSGIQPLLCSLIGLENPT

SEQ ID NO: 11320 - protein, 519 aa, Homo sapiens
  Payload ID: 2227
  Gene Symbol: CREB3L1
  Gene Name: cAMP responsive element binding protein 3-like 1
  Uniprot ID: Q96BA8
  ENSP ID: ENSP00000481956
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 11321 - protein, 520 aa, Homo sapiens
  Payload ID: 2228
  Gene Symbol: CREB3L2
  Gene Name: cAMP responsive element binding protein 3-like 2
  Uniprot ID: Q70SY1
  ENSP ID: ENSP00000329140
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHLVSAKLEGNETLKVVELDRRVNTTF

SEQ ID NO: 11322 - protein, 185 aa, Homo sapiens
  Payload ID: 2228
  Gene Symbol: CREB3L2
  Gene Name: cAMP responsive element binding protein 3-like 2
  ENSP ID: ENSP00000388917
MEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFASK

SEQ ID NO: 11323 - protein, 239 aa, Homo sapiens
  Payload ID: 2228
  Gene Symbol: CREB3L2
  Gene Name: cAMP responsive element binding protein 3-like 2
  ENSP ID: ENSP00000402889
NLPRRPRRLSSRLSTATPCARSLGPSRPSPTLPPVTASMTICYINSKWMYGPPSLCLGFASYEYCIFNPRLFEKNLLVSGPAWFKTRVVQGPTAYVFFSYEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFA

SEQ ID NO: 11324 - protein, 460 aa, Homo sapiens
  Payload ID: 2228
  Gene Symbol: CREB3L2
  Gene Name: cAMP responsive element binding protein 3-like 2
  Uniprot ID: Q70SY1
  ENSP ID: ENSP00000403550
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVGKTACGKLGRVLFYFPRAGFLSLPKGIFCESPMFKKW

SEQ ID NO: 11325 - protein, 248 aa, Homo sapiens
  Payload ID: 2228
  Gene Symbol: CREB3L2
  Gene Name: cAMP responsive element binding protein 3-like 2
  Uniprot ID: Q70SY1
  ENSP ID: ENSP00000410314
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFASK

SEQ ID NO: 11326 - protein, 150 aa, Homo sapiens
  Payload ID: 2228
  Gene Symbol: CREB3L2
  Gene Name: cAMP responsive element binding protein 3-like 2
  ENSP ID: ENSP00000478432
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSICHSDHHSHLHPVGKGGTSSGNEHWG

SEQ ID NO: 11327 - protein, 175 aa, Homo sapiens [sequence omitted]

SEQ ID NO: 11328 - protein, 461 aa, Homo sapiens
  Payload ID: 2229
  Gene Symbol: CREB3L3
  Gene Name: cAMP responsive element binding protein 3-like 3
  Uniprot ID: Q68CJ9
  ENSP ID: ENSP00000078445
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 11329 - protein, 460 aa, Homo sapiens
  Payload ID: 2229
  Gene Symbol: CREB3L3
  Gene Name: cAMP responsive element binding protein 3-like 3
  Uniprot ID: Q68CJ9
  ENSP ID: ENSP00000469355
MNTDLAAGKMASAACSMDPIDSFELLDLLFDRQDGILRHVELGEGWGHVKDQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 11330 - protein, 337 aa, Homo sapiens
  Payload ID: 2229
  Gene Symbol: CREB3L3
  Gene Name: cAMP responsive element binding protein 3-like 3
  Uniprot ID: Q68CJ9
  ENSP ID: ENSP00000470119
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKDVSLHCSESGVTEESLASREAKPVPLGATEETPGHCGAVHQQVSPDRHLCRSPVAVLCPHHPPLHQPFWPQQNREPWGLCACTSVLQNFAQRCCLPRGC

SEQ ID NO: 11331 - protein, 459 aa, Homo sapiens
  Payload ID: 2229
  Gene Symbol: CREB3L3
  Gene Name: cAMP responsive element binding protein 3-like 3
  Uniprot ID: Q68CJ9
  ENSP ID: ENSP00000472399
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 11332 - protein, 395 aa, Homo sapiens
  Payload ID: 2230
  Gene Symbol: CREB3L4
  Gene Name: cAMP responsive element binding protein 3-like 4
  Uniprot ID: Q8TEY5
  ENSP ID: ENSP00000271889
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 11333 - protein, 375 aa, Homo sapiens
  Payload ID: 2230
  Gene Symbol: CREB3L4
  Gene Name: cAMP responsive element binding protein 3-like 4
  Uniprot ID: Q8TEY5
  ENSP ID: ENSP00000357589
MDLGIPDLLDAWLEPPEDIFSTGSVLELGLHCPPPEVPGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 11334 - protein, 217 aa, Homo sapiens
  Payload ID: 2230
  Gene Symbol: CREB3L4
  Gene Name: cAMP responsive element binding protein 3-like 4
  ENSP ID: ENSP00000357590
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKVTCFP

SEQ ID NO: 11335 - protein, 395 aa, Homo sapiens; identical to SEQ ID NO: 11332
  Payload ID: 2230
  Gene Symbol: CREB3L4
  Gene Name: cAMP responsive element binding protein 3-like 4
  Uniprot ID: Q8TEY5
  ENSP ID: ENSP00000357592

SEQ ID NO: 11336 - protein, 395 aa, Homo sapiens; identical to SEQ ID NO: 11332
  Payload ID: 2230
  Gene Symbol: CREB3L4
  Gene Name: cAMP responsive element binding protein 3-like 4
  Uniprot ID: Q8TEY5
  ENSP ID: ENSP00000357596

SEQ ID NO: 11337 - protein, 228 aa, Homo sapiens
  Payload ID: 2230
  Gene Symbol: CREB3L4
  Gene Name: cAMP responsive element binding protein 3-like 4
  ENSP ID: ENSP00000391847
MDLGIPDLLDAWLEPPEDIFSTGSVLELGLHCPPPEVPGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESR

SEQ ID NO: 11338 - protein, 182 aa, Homo sapiens
  Payload ID: 2230
  Gene Symbol: CREB3L4
  Gene Name: cAMP responsive element binding protein 3-like 4
  ENSP ID: ENSP00000402308
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLV

SEQ ID NO: 11339 - protein, 508 aa, Homo sapiens
  Payload ID: 2231
  Gene Symbol: CREB5
  Gene Name: cAMP responsive element binding protein 5
  Uniprot ID: Q02930
  ENSP ID: ENSP00000350359
MIYEESKMNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 11340 - protein, 369 aa, Homo sapiens
  Payload ID: 2231
  Gene Symbol: CREB5
  Gene Name: cAMP responsive element binding protein 5
  Uniprot ID: Q02930
  ENSP ID: ENSP00000379592
MFCTSGGNSASVMSMRPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 11341 - protein, 475 aa, Homo sapiens
  Payload ID: 2231
  Gene Symbol: CREB5
  Gene Name: cAMP responsive element binding protein 5
  Uniprot ID: Q02930
  ENSP ID: ENSP00000379593
MIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 11342 - protein, 501 aa, Homo sapiens
  Payload ID: 2231
  Gene Symbol: CREB5
  Gene Name: cAMP responsive element binding protein 5
  Uniprot ID: Q02930
  ENSP ID: ENSP00000379594
MNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARLPNHDTNVVIQQAMPSPQSSSVITQAPSTNRQIGPVPGSLSSLLHLHNRQRQPMPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERNRAAATRCRQKRKVWVMSLEKKAEELTQTNMQLQNEVSMLKNEVAQLKQLLLTHKDCPITAMQKESQGYLSPESSPPASPVPACSQQQVIQHNTITTSSSVSEVVGSSTLSQLTTHRTDLNPIL

SEQ ID NO: 11343 - protein, 475 aa, Homo sapiens; identical to SEQ ID NO: 11341
  Payload ID: 2231
  Gene Symbol: CREB5
  Gene Name: cAMP responsive element binding protein 5
  Uniprot ID: Q02930
  ENSP ID: ENSP00000387197

SEQ ID NO: 11344 - protein, 115 aa, Homo sapiens
  Payload ID: 2231
  Gene Symbol: CREB5
  Gene Name: cAMP responsive element binding protein 5
  ENSP ID: ENSP00000394088
MNLEQERPFVCSAPGCSQRFPTEDHLMIHRHKHEMTLKFPSIKTDNMLSDQTPTPTRFLKNCEEVGLFSELDCSLEHEFRKAQEEESSKRNISMHNAVGGAMTGPGTHQLSSARL

SEQ ID NO: 11345 - protein, 211 aa, Homo sapiens
  Payload ID: 2231
  Gene Symbol: CREB5
  Gene Name: cAMP responsive element binding protein 5
  ENSP ID: ENSP00000394979
MPASMPGTLPNPTMPGSSAVLMPMERQMSVNSSIMGMQGPNLSNPCASPQVQPMHSEAKMRLKAALTHHPAAMSNGNMNTMGHMMEMMGSRQDQTPHHHMHSHPHQHQTLPPHHPYPHQHQHPAHHPHPQPHHQQNHPHHHSHSHLHAHPAHHQTSPHPPLHTGNQAQVSPATQQMQPTQTIQPPQPTGGRRRRVVDEDPDERRRKFLERN

SEQ ID NO: 11346 - protein, 39 aa, Homo sapiens
  Payload ID: 2231
  Gene Symbol: CREB5
  Gene Name: cAMP responsive element binding protein 5
  ENSP ID: ENSP00000440429
LQNEVSMLKNEVAQLKQLLLTHKDCPITAMQKESQGYLN

SEQ ID NO: 11347 - protein, 120 aa, Homo sapiens
  Payload ID: 2232
  Gene Symbol: CREBL2
  Gene Name: cAMP responsive element binding protein-like 2
  Uniprot ID: O60519
  ENSP ID: ENSP00000228865
MDDSKVVGGKVKKPGKRGRKPAKIDLKAKLERSRQSARECRARKKLRYQYLEELVSSRERAICALREELEMYKQWCMAMDQGKIPSEIKALLTGEEQNKSQQNSSRHTKAGKTDANSNSW

SEQ ID NO: 11348 - protein, 300 aa, Homo sapiens
  Payload ID: 2233
  Gene Symbol: CREM
  Gene Name: cAMP responsive element modulator
  Uniprot ID: Q03060
  ENSP ID: ENSP00000265372
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11349 - protein, 299 aa, Homo sapiens
  Payload ID: 2233
  Gene Symbol: CREM
  Gene Name: cAMP responsive element modulator
  Uniprot ID: Q03060
  ENSP ID: ENSP00000337138
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11350 - protein, 245 aa, Homo sapiens
  Payload ID: 2233
  Gene Symbol: CREM
  Gene Name: cAMP responsive element modulator
  Uniprot ID: Q03060
  ENSP ID: ENSP00000341875
MVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11351 - protein, 95 aa, Homo sapiens
  Payload ID: 2233
  Gene Symbol: CREM
  Gene Name: cAMP responsive element modulator
  ENSP ID: ENSP00000344365
MPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11352 - protein, 221 aa, Homo sapiens
  Payload ID: 2233
  Gene Symbol: CREM
  Gene Name: cAMP responsive element modulator
  Uniprot ID: Q03060
  ENSP ID: ENSP00000345384
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11353 - protein, 248 aa, Homo sapiens
  Payload ID: 2233
  Gene Symbol: CREM
  Gene Name: cAMP responsive element modulator
  Uniprot ID: Q03060
  ENSP ID: ENSP00000346804
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11354 - protein, 108 aa, Homo sapiens
  Payload ID: 2233
  Gene Symbol: CREM
  Gene Name: cAMP responsive element modulator
  Uniprot ID: Q03060
  ENSP ID: ENSP00000349387
MAVTGDDTAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11355 - protein, 270 aa, Homo sapiens
  Payload ID: 2233
  Gene Symbol: CREM
  Gene Name: cAMP responsive element modulator
  Uniprot ID: Q03060
  ENSP ID: ENSP00000354593
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11356 - protein, 269 aa, Homo sapiens
  Payload ID: 2233
  Gene Symbol: CREM
  Gene Name: cAMP responsive element modulator
  ENSP ID: ENSP00000363853
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11357 - protein, 137 aa, Homo sapiens
  Payload ID: 2233
  Gene Symbol: CREM
  Gene Name: cAMP responsive element modulator
  Uniprot ID: Q03060
  ENSP ID: ENSP00000363858
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYSMYAAIRYDTVLALSLL

SEQ ID NO: 11358 - protein, 221 aa, Homo sapiens; identical to SEQ ID NO: 11352
  Payload ID: 2233
  Gene Symbol: CREM
  Gene Name: cAMP responsive element modulator
  Uniprot ID: Q03060
  ENSP ID: ENSP00000363860

SEQ ID NO: 11359 - protein, 236 aa, Homo sapiens
  Payload ID: 2233
  Gene Symbol: CREM
  Gene Name: cAMP responsive element modulator
  Uniprot ID: Q03060
  ENSP ID: ENSP00000363866
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11360 - protein, 282 aa, Homo sapiens
  Payload ID: 2233
  Gene Symbol: CREM
  Gene Name: cAMP responsive element modulator
  Uniprot ID: Q03060
  ENSP ID: ENSP00000379225
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11361 - protein, 345 aa, Homo sapiens
  Payload ID: 2233
  Gene Symbol: CREM
  Gene Name: cAMP responsive element modulator
  ENSP ID: ENSP00000393538
MTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11362 - protein, 156 aa, Homo sapiens
  Payload ID: 2233
  Gene Symbol: CREM
  Gene Name: cAMP responsive element modulator
  ENSP ID: ENSP00000403938
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQ

SEQ ID NO: 11363 - protein, 248 aa, Homo sapiens; identical to SEQ ID NO: 11353
  Payload ID: 2233
  Gene Symbol: CREM
  Gene Name: cAMP responsive element modulator
  Uniprot ID: Q03060
  ENSP ID: ENSP00000409220

SEQ ID NO: 11364 - protein, 62 aa, Homo sapiens
  Payload ID: 2233
  Gene Symbol: CREM
  Gene Name: cAMP responsive element modulator
  ENSP ID: ENSP00000417058
MTMETVESQHDGSITASLTESKSAHVQTQTGQNSIPALAQLPLVTCQLTRSELLLLLCHREW

SEQ ID NO: 11365 - protein, 78 aa, Homo sapiens
  Payload ID: 2233
  Gene Symbol: CREM
  Gene Name: cAMP responsive element modulator
  ENSP ID: ENSP00000417130
MAVPTSIYQTSTGQYIAIAQGGTIQISNPGSDGVQGLQALTMTNSGAPPPGATIVQYAAQSADGTQQFFVPGSQVVVQ

SEQ ID NO: 11366 - protein, 219 aa, Homo sapiens
  Payload ID: 2233
  Gene Symbol: CREM
  Gene Name: cAMP responsive element modulator
  ENSP ID: ENSP00000417165
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11367 - protein, 113 aa, Homo sapiens
  Payload ID: 2233
  Gene Symbol: CREM
  Gene Name: cAMP responsive element modulator
  Uniprot ID: Q03060
  ENSP ID: ENSP00000417327
MNRTQELSGQLSAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11368 - protein, 115 aa, Homo sapiens
  Payload ID: 2233
  Gene Symbol: CREM
  Gene Name: cAMP responsive element modulator
  ENSP ID: ENSP00000417399
MAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQL

SEQ ID NO: 11369 - protein, 109 aa, Homo sapiens
  Payload ID: 2233
  Gene Symbol: CREM
  Gene Name: cAMP responsive element modulator
  Uniprot ID: Q03060
  ENSP ID: ENSP00000417460
MAVTGDDTAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11370 - protein, 112 aa, Homo sapiens
  Payload ID: 2233
  Gene Symbol: CREM
  Gene Name: cAMP responsive element modulator
  Uniprot ID: Q03060
  ENSP ID: ENSP00000417562
MNRTQELSGQLSAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11371 - protein, 121 aa, Homo sapiens
  Payload ID: 2233
  Gene Symbol: CREM
  Gene Name: cAMP responsive element modulator
  Uniprot ID: Q03060
  ENSP ID: ENSP00000417807
MAVTGDDTDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11372 - protein, 138 aa, Homo sapiens
  Payload ID: 2233
  Gene Symbol: CREM
  Gene Name: cAMP responsive element modulator
  Uniprot ID: Q03060
  ENSP ID: ENSP00000418336
MTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11373 - protein, 53 aa, Homo sapiens
  Payload ID: 2233
  Gene Symbol: CREM
  Gene Name: cAMP responsive element modulator
  ENSP ID: ENSP00000418450
  MOD_RES (1)..(1): Any amino acid
XDGSITASLTESKSAHVQTQTGQNSIPALAQLPLVTCQLTRSELLLLLCHREW

SEQ ID NO: 11374 - protein, 186 aa, Homo sapiens
  Payload ID: 2233
  Gene Symbol: CREM
  Gene Name: cAMP responsive element modulator
  ENSP ID: ENSP00000418798
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEY

SEQ ID NO: 11375 - protein, 96 aa, Homo sapiens
  Payload ID: 2233
  Gene Symbol: CREM
  Gene Name: cAMP responsive element modulator
  ENSP ID: ENSP00000419018
MPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11376 - protein, 102 aa, Homo sapiens
  Payload ID: 2233
  Gene Symbol: CREM
  Gene Name: cAMP responsive element modulator
  Uniprot ID: Q03060
  ENSP ID: ENSP00000419075
MAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11377 - protein, 193 aa, Homo sapiens
  Payload ID: 2233
  Gene Symbol: CREM
  Gene Name: cAMP responsive element modulator
  ENSP ID: ENSP00000419684
VAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11378 - protein, 125 aa, Homo sapiens
  Payload ID: 2233
  Gene Symbol: CREM
  Gene Name: cAMP responsive element modulator
  Uniprot ID: Q03060
  ENSP ID: ENSP00000419810
MNRTQELSGQLSDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11379 - protein, 137 aa, Homo sapiens; identical to SEQ ID NO: 11357
  Payload ID: 2233
  Gene Symbol: CREM
  Gene Name: cAMP responsive element modulator
  Uniprot ID: Q03060
  ENSP ID: ENSP00000419924

SEQ ID NO: 11380 - protein, 95 aa, Homo sapiens; identical to SEQ ID NO: 11351
  Payload ID: 2233
  Gene Symbol: CREM
  Gene Name: cAMP responsive element modulator
  ENSP ID: ENSP00000420437

SEQ ID NO: 11381 - protein, 46 aa, Homo sapiens
  Payload ID: 2233
  Gene Symbol: CREM
  Gene Name: cAMP responsive element modulator
  ENSP ID: ENSP00000420453
MTMETVESQHDGSITASLTESKSAHVQTQTGQNSIPALAQKILYYR

SEQ ID NO: 11382 - protein, 312 aa, Homo sapiens
  Payload ID: 2233
  Gene Symbol: CREM
  Gene Name: cAMP responsive element modulator
  Uniprot ID: Q03060
  ENSP ID: ENSP00000420511
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 11383 - protein, 120 aa, Homo sapiens
  Payload ID: 2233
  Gene Symbol: CREM
  Gene Name: cAMP responsive element modulator
  Uniprot ID: Q03060
  ENSP ID: ENSP00000420681
MAVTGDDTDEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 11384 - protein, 59 aa, Homo sapiens
  Payload ID: 2233
  Gene Symbol: CREM
  Gene Name: cAMP responsive element modulator
  ENSP ID: ENSP00000473519
MTMETVESQHDGSITASLTESKSAHVQTQTGQNSIPALAQCTMCKESLGIKQPWHAIGD

SEQ ID NO: 11385 - protein, 112 aa, Homo sapiens
  Payload ID: 2234
  Gene Symbol: ARPP19
  Gene Name: cAMP-regulated phosphoprotein, 19kDa
  Uniprot ID: P56211
  ENSP ID: ENSP00000249822
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 11386 - protein, 96 aa, Homo sapiens
  Payload ID: 2234
  Gene Symbol: ARPP19
  Gene Name: cAMP-regulated phosphoprotein, 19kDa
  Uniprot ID: P56211
  ENSP ID: ENSP00000454234
MEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 11387 - protein, 112 aa, Homo sapiens; identical to SEQ ID NO: 11385
  Payload ID: 2234
  Gene Symbol: ARPP19
  Gene Name: cAMP-regulated phosphoprotein, 19kDa
  Uniprot ID: P56211
  ENSP ID: ENSP00000454297

SEQ ID NO: 11388 - protein, 131 aa, Homo sapiens
  Payload ID: 2234
  Gene Symbol: ARPP19
  Gene Name: cAMP-regulated phosphoprotein, 19kDa
  ENSP ID: ENSP00000454341
MSAEVPEAASAEEQKSEHNMLPWSLQPSIPNSLEEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 11389 - protein, 131 aa, Homo sapiens; identical to SEQ ID NO: 11388
  Payload ID: 2234
  Gene Symbol: ARPP19
  Gene Name: cAMP-regulated phosphoprotein, 19kDa
  ENSP ID: ENSP00000454612

SEQ ID NO: 11390 - protein, 112 aa, Homo sapiens; identical to SEQ ID NO: 11385
  Payload ID: 2234
  Gene Symbol: ARPP19
  Gene Name: cAMP-regulated phosphoprotein, 19kDa
  Uniprot ID: P56211
  ENSP ID: ENSP00000455151

SEQ ID NO: 11391 - protein, 71 aa, Homo sapiens
  Payload ID: 2234
  Gene Symbol: ARPP19
  Gene Name: cAMP-regulated phosphoprotein, 19kDa
  ENSP ID: ENSP00000455610
MSAEVPEAASAEEQKQKYFDSGDYNMAKAKMKNKQLPTAAPDKTEVTGDHIPTPQDLPQRKPSLVASKLAG

SEQ ID NO: 11392 - protein, 112 aa, Homo sapiens; identical to SEQ ID NO: 11385
  Payload ID: 2234
  Gene Symbol: ARPP19
  Gene Name: cAMP-regulated phosphoprotein, 19kDa
  Uniprot ID: P56211
  ENSP ID: ENSP00000455625

SEQ ID NO: 11393 - protein, 96 aa, Homo sapiens; identical to SEQ ID NO: 11386
  Payload ID: 2234
  Gene Symbol: ARPP19
  Gene Name: cAMP-regulated phosphoprotein, 19kDa
  Uniprot ID: P56211
  ENSP ID: ENSP00000455986

SEQ ID NO: 11394 - protein, 72 aa, Homo sapiens
  Payload ID: 2234
  Gene Symbol: ARPP19
  Gene Name: cAMP-regulated phosphoprotein, 19kDa
  ENSP ID: ENSP00000457123
MEDKVTSPEKAEEAKLKARYPHLGQKPGGSDFLRKRLQKGQKYFDSGDYNMAKAKMKNKQLPTAAPDKTEVT

SEQ ID NO: 11395 - protein, 96 aa, Homo sapiens; identical to SEQ ID NO: 11386
  Payload ID: 2234
  Gene Symbol: ARPP19
  Gene Name: cAMP-regulated phosphoprotein, 19kDa
  Uniprot ID: P56211
  ENSP ID: ENSP00000457631

SEQ ID NO: 11396 - protein, 96 aa, Homo sapiens; identical to SEQ ID NO: 11386
  Payload ID: 2234
  Gene Symbol: ARPP19
  Gene Name: cAMP-regulated phosphoprotein, 19kDa
  Uniprot ID: P56211
  ENSP ID: ENSP00000457805

SEQ ID NO: 11397 - protein, 812 aa, Homo sapiens
  Payload ID: 2235
  Gene Symbol: ARPP21
  Gene Name: cAMP-regulated phosphoprotein, 21kDa
  Uniprot ID: Q9UBL0
  ENSP ID: ENSP00000187397
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQQNRMHPFRDDRRSKSIEEREEEYQRVRERIFAHDSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 11398 - protein, 89 aa, Homo sapiens
  Payload ID: 2235
  Gene Symbol: ARPP21
  Gene Name: cAMP-regulated phosphoprotein, 21kDa
  Uniprot ID: Q9UBL0
  ENSP ID: ENSP00000379741
MSEQGDLNQAIAEEGGTEQETATPENGIVKSESLDEEEKLELQRRLEAQNQERRKSKSGAGKGKLTRSLAVCEESSARPGGESLQDQTL

SEQ ID NO: 11399 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000379742

SEQ ID NO: 11400 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000389754

SEQ ID NO: 11401 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000390151

SEQ ID NO: 11402 - protein, 98 aa, Homo sapiens
  Payload ID: 2235
  Gene Symbol: ARPP21
  Gene Name: cAMP-regulated phosphoprotein, 21kDa
  ENSP ID: ENSP00000390169
MSEQGDLNQAIAEEGGTEQETATPENGIVKSESLDEEEKLELQRRLEAQNQERRKSKSGAGKGKLTRSLAVCEESSARPGGESLQDQESIHLQLSSFS

SEQ ID NO: 11403 - protein, 124 aa, Homo sapiens
  Payload ID: 2235
  Gene Symbol: ARPP21
  Gene Name: cAMP-regulated phosphoprotein, 21kDa
  ENSP ID: ENSP00000396116
  MOD_RES (1)..(1): Any amino acid
XCRDRMILLKMEQEIIDFIADNNNHYKKFPQMSSYQRMLVHRVAAYFGLDHNVDQTGKSVIINKTSSTRIQFAPRKAFLWKTGATEMAQGEHLGVDRAAQKMNSSGLTTKGPGAAQTPTVPTAI

SEQ ID NO: 11404 - protein, 96 aa, Homo sapiens
  Payload ID: 2235
  Gene Symbol: ARPP21
  Gene Name: cAMP-regulated phosphoprotein, 21kDa
  ENSP ID: ENSP00000396324
MSEQGDLNQAIAEEGGTEQETATPENGIVKSESLDEEEKLELQRRLEAQNQERRKSKSGAGKGKLTRSLAVCEESSARPGGESLQDQVYPLAIIIN

SEQ ID NO: 11405 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000397720

SEQ ID NO: 11406 - protein, 32 aa, Homo sapiens
  Payload ID: 2235
  Gene Symbol: ARPP21
  Gene Name: cAMP-regulated phosphoprotein, 21kDa
  ENSP ID: ENSP00000398598
MSEQGDLNQAIAEEGGTEQETATPENGIVKSE

SEQ ID NO: 11407 - protein, 145 aa, Homo sapiens
  Payload ID: 2235
  Gene Symbol: ARPP21
  Gene Name: cAMP-regulated phosphoprotein, 21kDa
  ENSP ID: ENSP00000399482
  MOD_RES (1)..(1): Any amino acid
XQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQLCPSVVHKLSWIINTDR

SEQ ID NO: 11408 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000401602

SEQ ID NO: 11409 - protein, 793 aa, Homo sapiens
  Payload ID: 2235
  Gene Symbol: ARPP21
  Gene Name: cAMP-regulated phosphoprotein, 21kDa
  Uniprot ID: Q9UBL0
  ENSP ID: ENSP00000405276
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 11410 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000406964

SEQ ID NO: 11411 - protein, 261 aa, Homo sapiens
  Payload ID: 2235
  Gene Symbol: ARPP21
  Gene Name: cAMP-regulated phosphoprotein, 21kDa
  ENSP ID: ENSP00000408271
  MOD_RES (1)..(1): Any amino acid
XFCRDRMILLKMEQEIIDFIADNNNHYKKFPQMSSYQRMLVHRVAAYFGLDHNVDQTGKSVIINKTSSTRIQFAPRKAFLWKTVGSWKTVTYAMRPIRKDSSFGWGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGE

SEQ ID NO: 11412 - protein, 94 aa, Homo sapiens
  Payload ID: 2235
  Gene Symbol: ARPP21
  Gene Name: cAMP-regulated phosphoprotein, 21kDa
  ENSP ID: ENSP00000409331
MSEQGDLNQAIAEEGGTEQETATPENGIVKSESLDEEEKLELQRRLEAQNQERRKSKSGAGKGKLTRSLAVCEESSARPGGESLQDQESIHLQL

SEQ ID NO: 11413 - protein, 54 aa, Homo sapiens
  Payload ID: 2235
  Gene Symbol: ARPP21
  Gene Name: cAMP-regulated phosphoprotein, 21kDa
  ENSP ID: ENSP00000409808
MSEQGDLNQAIAEEGGTEQETATPENGIVKSESLDEEEKLELQRRLEAQNQERR

SEQ ID NO: 11414 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000410171

SEQ ID NO: 11415 - protein, 104 aa, Homo sapiens
  Payload ID: 2235
  Gene Symbol: ARPP21
  Gene Name: cAMP-regulated phosphoprotein, 21kDa
  ENSP ID: ENSP00000411644
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEED

SEQ ID NO: 11416 - protein, 241 aa, Homo sapiens
  Payload ID: 2235
  Gene Symbol: ARPP21
  Gene Name: cAMP-regulated phosphoprotein, 21kDa
  ENSP ID: ENSP00000412233
GSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTALCESRWNSCNIQPTHQSAAPAKRHGGAVPTAATTAAALPAAPTAGPATAATDGRPSGHSVCPGAAGFLPVSAISSSLFSSPAPPTCVSNAALSHER

SEQ ID NO: 11417 - protein, 813 aa, Homo sapiens
  Payload ID: 2235
  Gene Symbol: ARPP21
  Gene Name: cAMP-regulated phosphoprotein, 21kDa
  Uniprot ID: Q9UBL0
  ENSP ID: ENSP00000412326
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 11418 - protein, 101 aa, Homo sapiens
  Payload ID: 2235
  Gene Symbol: ARPP21
  Gene Name: cAMP-regulated phosphoprotein, 21kDa
  ENSP ID: ENSP00000412341
MSEQGDLNQAIAEEGGTEQETATPENGIVKSESLDEEEKLELQRRLEAQNQERRKSKSGAGKGKLTRSLAVCEESSARPGGESLQDQVYPLAIIINCMNGI

SEQ ID NO: 11419 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000412411

SEQ ID NO: 11420 - protein, 43 aa, Homo sapiens
  Payload ID: 2235
  Gene Symbol: ARPP21
  Gene Name: cAMP-regulated phosphoprotein, 21kDa
  ENSP ID: ENSP00000413005
MSEQGDLNQAIAEEGGTEQETATPENGIVKSESLDEEEKLELQ

SEQ ID NO: 11421 - protein, 98 aa, Homo sapiens
  Payload ID: 2235
  Gene Symbol: ARPP21
  Gene Name: cAMP-regulated phosphoprotein, 21kDa
  ENSP ID: ENSP00000415134
MSEQGDLNQAIAEEGGTEQETATPENGIVKSESLDEEEKLELQRRLEAQNQERRKSKSGAGKGKLTRSLAVCEESSARPGGESLQDQIAAKNTRILQA

SEQ ID NO: 11422 - protein, 89 aa, Homo sapiens; identical to SEQ ID NO: 11398
  Payload ID: 2235
  Gene Symbol: ARPP21
  Gene Name: cAMP-regulated phosphoprotein, 21kDa
  Uniprot ID: Q9UBL0
  ENSP ID: ENSP00000417838

SEQ ID NO: 11423 - protein, 641 aa, Homo sapiens
  Payload ID: 2236
  Gene Symbol: CAGE1
  Gene Name: cancer antigen 1
  Uniprot ID: Q8TC20
  ENSP ID: ENSP00000296742
MTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKEVIDCDSDEAKSIRDVPTLLGAKLDKYHSLNEELDFLVTSYEEIIECADQRLAISHSQIAHLEERNKHLEDLIRKPREKARKPRSKSLENHPKSMTMMPALFKENRNDLD

SEQ ID NO: 11424 - protein, 824 aa, Homo sapiens
  Payload ID: 2236
  Gene Symbol: CAGE1
  Gene Name: cancer antigen 1
  Uniprot ID: Q8TC20
  ENSP ID: ENSP00000338107
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVIDCDSDEAKSIRDVPTLLGAKLDKYHSLNEELDFLVTSYEEIIECADQRLAISHSQIAHLEERNKHLEDLIRKPREKARKPRSKSLENHPKSMTMLAYNLYIFIGYRLGAVADACNPSTLGGRGGWIT

SEQ ID NO: 11425 - protein, 817 aa, Homo sapiens
  Payload ID: 2236
  Gene Symbol: CAGE1
  Gene Name: cancer antigen 1
  ENSP ID: ENSP00000369250
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKLLKHKDRITTFRELIAKEKAFQDHAIKVIDCDSDEAKSIRDVPTLLGAKLDKYHSLNEELDFLITKLGHLLESKENHCNRLIEENDKYQRHLGNLIKKVTSYEEIIECADQRLAISHSQIAHLEERNKHLEDLIRKPREKARKPRSKSLENHPKSMTMMPALFKENRNDLD

SEQ ID NO: 11426 - protein, 700 aa, Homo sapiens
  Payload ID: 2236
  Gene Symbol: CAGE1
  Gene Name: cancer antigen 1
  Uniprot ID: Q8TC20
  ENSP ID: ENSP00000390644
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVFQGV

SEQ ID NO: 11427 - protein, 242 aa, Homo sapiens
  Payload ID: 2236
  Gene Symbol: CAGE1
  Gene Name: cancer antigen 1
  ENSP ID: ENSP00000391746
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLYCSSFKRNTELWGDS

SEQ ID NO: 11428 - protein, 558 aa, Homo sapiens
  Payload ID: 2236
  Gene Symbol: CAGE1
  Gene Name: cancer antigen 1
  ENSP ID: ENSP00000423789
MDPGKVFYCSTVMNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAK

SEQ ID NO: 11429 - protein, 839 aa, Homo sapiens
  Payload ID: 2236
  Gene Symbol: CAGE1
  Gene Name: cancer antigen 1
  Uniprot ID: Q8TC20
  ENSP ID: ENSP00000425493
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKELLKHKDRITTFRELIAKEKAFQDHAIKVIDCDSDEAKSIRDVPTLLGAKLDKYHSLNEELDFLITKLGHLLESKENHCNRLIEENDKYQRHLGNLIKKVTSYEEIIECADQRLAISHSQIAHLEERNKHLEDLIRKPREKARKPRSKSLENHPKSMTMMPALFKENRNDLD

SEQ ID NO: 11430 - protein, 777 aa, Homo sapiens
  Payload ID: 2236
  Gene Symbol: CAGE1
  Gene Name: cancer antigen 1
  Uniprot ID: Q8TC20
  ENSP ID: ENSP00000427583
MNKDYQKFWSSPSDPVHFEVDTSHEKVESMSESDTMNVSNLSQGVMLSHSPICMETTGTTCDLPQNEIKNFERENEYESTLCEDAYGTLDNLLNDNNIENYSTNALIQPVDTISISSLRQFETVCKFHWVEAFDDEMTEKPEFQSQVYNYAKDNNIKQDSFKEENPMETSVSANTDQLGNEYFRQPPPRSPPLIHCSGEMLKFTEKSLAKSIAKESALNPSQPPSFLCKTAVPSKEIQNYGEIPEMSVSYEKEVTAEGVERPEIVSTWSSAGISWRSEACRENCEMPDWEQSAESLQPVQEDMALNEVLQKLKHTNRKQEVRIQELQCSNLYLEKRVKELQMKITKQQVFIDVINKLKENVEELIEDKYKIILEKNDTKKTLQNLEEVLANTQKHLQESRNDKEMLQLQFKKIKANYVCLQERYMTEMQQKNKSVSQYLEMDKTLSKKEEEVERLQQLKKELEKATASALDLLKREKEAQEQEFLSLQEEFQKLEKENLEERQKLKSRLEKLLTQVRNLQFMSENERTKNIKLQQQINEVKNENAKLKQQVARSEEQNYVPKFETAQLKDQLEEVLKSDITKDTKTTHSNLLPDCSPCEERLNPADIKRASQLASKMHSLLALMVGLLTCQDIINSDAEHFKESEKVSDIMLQKLKSLHLKKKTLDKEVIDCDSDEAKSIRDVPTLLGAKLDKYHSLNEELDFLVTSYEEIIECADQRLAISHSQIAHLEERNKHLEDLIRKPREKARKPRSKSLENHPKSMTMMPALFKENRNDLD

SEQ ID NO: 11431 - protein, 716 aa, Homo sapiens
  Payload ID: 2237
  Gene Symbol: CASC1
  Gene Name: cancer susceptibility candidate 1
  Uniprot ID: Q6TDU7
  ENSP ID: ENSP00000313141
MSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 11432 - protein, 690 aa, Homo sapiens
  Payload ID: 2237
  Gene Symbol: CASC1
  Gene Name: cancer susceptibility candidate 1
  Uniprot ID: Q6TDU7
  ENSP ID: ENSP00000346126
MRQTGGGATTDSASPVLNNVIKSQSYFTAKRVGLGNNSYLGVGRPSSQQWLSLPGPGGQGPKAKKSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKW

SEQ ID NO: 11433 - protein, 722 aa, Homo sapiens
  Payload ID: 2237
  Gene Symbol: CASC1
  Gene Name: cancer susceptibility candidate 1
  ENSP ID: ENSP00000379310
MGPKAKKSGSKKKKVTKAERLKLLQEEEERRLKEEEEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 11434 - protein, 676 aa, Homo sapiens
  Payload ID: 2237
  Gene Symbol: CASC1
  Gene Name: cancer susceptibility candidate 1
  Uniprot ID: Q6TDU7
  ENSP ID: ENSP00000379313
MERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 11435 - protein, 657 aa, Homo sapiens
  Payload ID: 2237
  Gene Symbol: CASC1
  Gene Name: cancer susceptibility candidate 1
  Uniprot ID: Q6TDU7
  ENSP ID: ENSP00000437373
MDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKQASTLADLDSGNMEKVIKDENVTLYVWANLKKNPRHRSVRFSETQIGFEIPRILATSDIAVRLLHTHYDHVSALHPVSTPSKEYTSAVTELVKDDVKNVEKAISKEVEEESKQQERGSHLIQEEEIKVEEEQGDIEVKMSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 11436 - protein, 35 aa, Homo sapiens
  Payload ID: 2237
  Gene Symbol: CASC1
  Gene Name: cancer susceptibility candidate 1
  ENSP ID: ENSP00000450703
MSGSKKKKVTKAERLKLLQEEEERRLKEEGSRKEK

SEQ ID NO: 11437 - protein, 45 aa, Homo sapiens
  Payload ID: 2237
  Gene Symbol: CASC1
  Gene Name: cancer susceptibility candidate 1
  ENSP ID: ENSP00000451011
MSGSKKKKVTKAERLKLLQEEEERRLKEEVTVLKKGELTLFSYLP

SEQ ID NO: 11438 - protein, 92 aa, Homo sapiens
  Payload ID: 2237
  Gene Symbol: CASC1
  Gene Name: cancer susceptibility candidate 1
  ENSP ID: ENSP00000451232
MERLEIQRIEKEKWHRLEAKDLERRNEELEELYLLERCFPEAEKLKQETKLLSQWKHYIQCDGSPDPSVAQEMNTFISLWKEKTNETFEEVI

SEQ ID NO: 11439 - protein, 548 aa, Homo sapiens
  Payload ID: 2237
  Gene Symbol: CASC1
  Gene Name: cancer susceptibility candidate 1
  ENSP ID: ENSP00000451813
  MOD_RES (1)..(1): Any amino acid
XEARLKYEKEEMERLEIQRIEKEKWHRLEAKDLERRNEELEELYLLERCFPEAEKLKQETKLLSQWKHYIQCDGSPDPSVAQEMNTFISLWKEKTNETFEEVIEKSKVVLNLIEKLKFILLETPPCDLQDKNIIQYQESILQLQELLHLKFGVATEILLKSSAEEESEAIKCEREMKVLSETVSAAQLLLVENSSEKPDFFEDNVVDLCQFTTLGGVYHLDILELPPQCKPVKGWMIVEILKEGLQKYTYPPETTEEFETENAFPPIEVTLEVHENVIFFEDPVVVRWDAEGKHWRTDGISNVSYKPKERLVTFSLDTFGPVTLIQDAHINMPYQSWELRPLDVNKVLLTVTTVFTEIQIQIKENLCMLSSIKLKDKKHISILEGTWMTPIPFIIALKEAGLNIFPTRHSHFYVIINNKVPLVEVKAYRQMALLSSAFAFGWSKWNLLCNSTKVVFKVREHLTEACTENPNWALLMFSGDRAQRLKIKEESEAFSEALKEETEFHSTLYHMVKDFASEEAMEKVRSSNCQFVNSVCHMLLSTRLLSYS

SEQ ID NO: 11440 - protein, 136 aa, Homo sapiens
  Payload ID: 2238
  Gene Symbol: CASC10
  Gene Name: cancer susceptibility candidate 10
  Uniprot ID: Q5T4H9
  ENSP ID: ENSP00000366317
MQSREPSGWRTAERRRGWRCRGVPTPSGDRGPGAARPAARGGAGETTGQQRPLQVPGASAAAARTRLLRWHHRVPSPRATRSPGSIRRTSPCSGGPDRPERPECADACCYLLDPFTLPLIQDFFRGCAASDFDRRD

SEQ ID NO: 11441 - protein, 703 aa, Homo sapiens
  Payload ID: 2239
  Gene Symbol: CASC3
  Gene Name: cancer susceptibility candidate 3
  Uniprot ID: O15234
  ENSP ID: ENSP00000264645
MADRRRQRASQDTEDEESGASGSDSGGSPLRGGGSCSGSAGGGGSGSLPSQRGGRTGALHLRRVESGGAKSAEESECESEDGIEGDAVLSDYESAEDSEGEEGEYSEEENSKVELKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGTGRMSAPRNYSRSGGFKEGRAGFRPVEAGGQHGGRSGETVKHEISYRSRRLEQTSVRDPSPEADAPVLGSPEKEEAASEPPAAAPDAAPPPPDRPIEKKSYSRARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMGVQGGRAKRYSSQRQRPVPEPPAPPVHISIMEGHYYDPLQFQGPIYTHGDSPAPLPPQGMLVQPGMNLPHPGLHPHQTPAPLPNPGLYPPPVSMSPGQPPPQQLLAPTYFSAPGVMNFGNPSYPYAPGALPPPPPPHLYPNTQAPSQVYGGVTYYNPAQQQVQPKPSPPRRTPQPVTIKPPPPEVVSRGSS

SEQ ID NO: 11442 - protein, 223 aa, Homo sapiens
  Payload ID: 2239
  Gene Symbol: CASC3
  Gene Name: cancer susceptibility candidate 3
  ENSP ID: ENSP00000462713
  MOD_RES (1)..(1): Any amino acid
XLKSEANDAVNSSTKEEKGEEKPDTKSTVTGERQSGDGQESTEPVENKVGKKGPKHLDDDEDRKNPAYIPRKGLFFEHDLRGQTQEEEVRPKGRQRKLWKDEGRWEHDKFREDEQAPKSRQELIALYGYDIRSAHNPDDIKPRRIRKPRYGSPPQRDPNWNGERLNKSHRHQGLGGTLPPRTFINRNAAGPLRRNPIPGQEELEPKLEMQSSLQRRCPLLLKD

SEQ ID NO: 11443 - protein, 129 aa, Homo sapiens
  Payload ID: 2239
  Gene Symbol: CASC3
  Gene Name: cancer susceptibility candidate 3
  ENSP ID: ENSP00000464626
  MOD_RES (1)..(1): Any amino acid
XARRTRTKVGDAVKLAEEVPPPPEGLIPAPPVPETTPTPPTKTGTWEAPVDSSTSGLEQDVAQLNIAEQNWSPGQPSFLQPRELRGMPNHIHMGAGPPPQFNRMEEMLTLQISIKYLPCTKCFSTPKGR

SEQ ID NO: 11444 - protein, 66 aa, Homo sapiens
  Payload ID: 2239
  Gene Symbol: CASC3
  Gene Name: cancer susceptibility candidate 3
  ENSP ID: ENSP00000467654
MSSAFFQESEDGIEGDAVLSDYESAEDSEGEEGEYSEEENSKVELKSEANDAVNSSTKEEKGEEKP

SEQ ID NO: 11445 - protein, 436 aa, Homo sapiens [sequence omitted]

SEQ ID NO: 11446 - protein, 380 aa, Homo sapiens
  Payload ID: 2240
  Gene Symbol: CASC4
  Gene Name: cancer susceptibility candidate 4
  Uniprot ID: Q6P4E1
  ENSP ID: ENSP00000335063
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPALRKPPISVSQHESHQAISHLPTGQPLSPNMPPDSHINHNGNPGTSKQNPSSPLQRLIPGSNLDSEPRIQTDILKQATKDRVSDFHKLKQNDEERELQMDPADYGKQHFNDVL

SEQ ID NO: 11447 - protein, 24 aa, Homo sapiens
  Payload ID: 2240
  Gene Symbol: CASC4
  Gene Name: cancer susceptibility candidate 4
  ENSP ID: ENSP00000452833
QDDEERELQMDPADYGKQHFNDVL

SEQ ID NO: 11448 - protein, 161 aa, Homo sapiens
  Payload ID: 2240
  Gene Symbol: CASC4
  Gene Name: cancer susceptibility candidate 4
  ENSP ID: ENSP00000453465
  MOD_RES (1)..(1): Any amino acid
XETQKIQSNDGKELDINNQVVPKNIPKVAENVADKNEEPSSNHIPHGKALRKPPISVSQHESHQAISHLPTGQPLSPNMPPDSHINHNGNPGTSKQNPSSPLQRLIPGSNLDSEPRIQTDILKQATKDRVSDFHKLKQNDEERELQMDPADYGKQHFNDVL

SEQ ID NO: 11449 - protein, 112 aa, Homo sapiens
  Payload ID: 2240
  Gene Symbol: CASC4
  Gene Name: cancer susceptibility candidate 4
  ENSP ID: ENSP00000453703
MADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEP

SEQ ID NO: 11450 - protein, 177 aa, Homo sapiens
  Payload ID: 2240
  Gene Symbol: CASC4
  Gene Name: cancer susceptibility candidate 4
  Uniprot ID: Q6P4E1
  ENSP ID: ENSP00000453720
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESKRPKRFNQMMERNWI

SEQ ID NO: 11451 - protein, 82 aa, Homo sapiens
  Payload ID: 2240
  Gene Symbol: CASC4
  Gene Name: cancer susceptibility candidate 4
  ENSP ID: ENSP00000453850
  MOD_RES (1)..(1): Any amino acid
XRPRLQLLEHLLPPRPASGGGGRAAGPGPAHRSGPRAAGKAQFGPLAVGGHAQETDRPEGGRLRPPQQPAAGQRGPREEMRG

SEQ ID NO: 11452 - protein, 2342 aa, Homo sapiens
  Payload ID: 2241
  Gene Symbol: CASC5
  Gene Name: cancer susceptibility candidate 5
  Uniprot ID: Q8NG31
  ENSP ID: ENSP00000335463
MDGVSSEANEENDNIERPVRRRHSSILKPPRSPLQDLRGGNERVQESNALRNKKNSRRVSFADTIKVFQTESHMKIVRKSEMEGCSAMVPSQLQLLPPGFKRFSCLSLPETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 11453 - protein, 2316 aa, Homo sapiens
  Payload ID: 2241
  Gene Symbol: CASC5
  Gene Name: cancer susceptibility candidate 5
  Uniprot ID: Q8NG31
  ENSP ID: ENSP00000382576
MDGVSSEANEENDNIERPVRRRHSSILKPPRSPLQDLRGGNERVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 11454 - protein, 1361 aa, Homo sapiens
  Payload ID: 2241
  Gene Symbol: CASC5
  Gene Name: cancer susceptibility candidate 5
  ENSP ID: ENSP00000432565
  MOD_RES (1)..(1): Any amino acid
XSHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 11455 - protein, 1746 aa, Homo sapiens
  Payload ID: 2241
  Gene Symbol: CASC5
  Gene Name: cancer susceptibility candidate 5
  ENSP ID: ENSP00000432654
MDGVSSEANEENDNIERPVRRRHSSILKPPRSPLQDLRGGNERVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKNVGTRRRRYS

SEQ ID NO: 11456 - protein, 193 aa, Homo sapiens
  Payload ID: 2241
  Gene Symbol: CASC5
  Gene Name: cancer susceptibility candidate 5
  ENSP ID: ENSP00000436851
  MOD_RES (1)..(1): Any amino acid
XDHHTEEDIDKSANSVLIKNLSRTPSSCSSSLDSIKADGTSLDFSTYRSSQMESQFLRDTICEESLREFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKIL

SEQ ID NO: 11457 - protein, 80 aa, Homo sapiens
  Payload ID: 2241
  Gene Symbol: CASC5
  Gene Name: cancer susceptibility candidate 5
  ENSP ID: ENSP00000453857
MDGVSSEANEENDNIERPVRRRHSSILKPPRSPLQDLRGPHLDTETPTEQSPRQFYCKHTTYSRRPDVKSICLPTQDTDL

SEQ ID NO: 11458 - protein, 10 aa, Homo sapiens
  Payload ID: 2241
  Gene Symbol: CASC5
  Gene Name: cancer susceptibility candidate 5
  ENSP ID: ENSP00000454002
MKIVRKSEME

SEQ ID NO: 11459 - protein, 7 aa, Homo sapiens
  Payload ID: 2241
  Gene Symbol: CASC5
  Gene Name: cancer susceptibility candidate 5
  ENSP ID: ENSP00000454087
MKIVRKS

SEQ ID NO: 11460 - protein, 180 aa, Homo sapiens
  Payload ID: 2242
  Gene Symbol: CTAG1A
  Gene Name: cancer/testis antigen 1A
  Uniprot ID: P78358
  ENSP ID: ENSP00000469441
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 11461 - protein, 210 aa, Homo sapiens
  Payload ID: 2242
  Gene Symbol: CTAG1A
  Gene Name: cancer/testis antigen 1A
  ENSP ID: ENSP00000472220
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTMSVQDQDRDGAGWRSVAGWGLGSAYPHGQAARNLGTPQHRVSEQRPGTPGPPPPEGAQGDGCRGVAFNVMFSAPHI

SEQ ID NO: 11462 - protein, 180 aa, Homo sapiens; identical to SEQ ID NO: 11460
  Payload ID: 2243
  Gene Symbol: CTAG1B
  Gene Name: cancer/testis antigen 1B
  Uniprot ID: P78358
  ENSP ID: ENSP00000332602

SEQ ID NO: 11463 - protein, 168 aa, Homo sapiens
  Payload ID: 2243
  Gene Symbol: CTAG1B
  Gene Name: cancer/testis antigen 1B
  Uniprot ID: P78358
  ENSP ID: ENSP00000352953
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTMSVQDQDRDGAWVGGGHSVAGWGLGSAYTPRSGC

SEQ ID NO: 11464 - protein, 210 aa, Homo sapiens; identical to SEQ ID NO: 11461
  Payload ID: 2243
  Gene Symbol: CTAG1B
  Gene Name: cancer/testis antigen 1B
  ENSP ID: ENSP00000469269

SEQ ID NO: 11465 - protein, 210 aa, Homo sapiens
  Payload ID: 2244
  Gene Symbol: CTAG2
  Gene Name: cancer/testis antigen 2
  Uniprot ID: O75638
  ENSP ID: ENSP00000247306
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 11466 - protein, 180 aa, Homo sapiens
  Payload ID: 2244
  Gene Symbol: CTAG2
  Gene Name: cancer/testis antigen 2
  Uniprot ID: O75638
  ENSP ID: ENSP00000358598
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 11467 - protein, 264 aa, Homo sapiens
  Payload ID: 2245
  Gene Symbol: CT55
  Gene Name: cancer/testis antigen 55
  Uniprot ID: Q8WUE5
  ENSP ID: ENSP00000276241
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKSSSGFQDDGGLGRPKRERRSQSI

SEQ ID NO: 11468 - protein, 242 aa, Homo sapiens
  Payload ID: 2245
  Gene Symbol: CT55
  Gene Name: cancer/testis antigen 55
  Uniprot ID: Q8WUE5
  ENSP ID: ENSP00000343893
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKS

SEQ ID NO: 11469 - protein, 136 aa, Homo sapiens
  Payload ID: 2246
  Gene Symbol: CT62
  Gene Name: cancer/testis antigen 62
  Uniprot ID: P0C5K7
  ENSP ID: ENSP00000399356
MMHTTSYRRLSPPHLTDQPSAYSHTHRTFSHFSCGSQPAAQRLHVELWNADLQSEFLCPCLGLTLYLTCNPQLGKRKFCSHSSEDMSKMVSRRNVKDSHEVSGSLQATLQVISFSFPFLLHTCSHPLSHPTSGQRR

SEQ ID NO: 11470 - protein, 97 aa, Homo sapiens
  Payload ID: 2246
  Gene Symbol: CT62
  Gene Name: cancer/testis antigen 62
  ENSP ID: ENSP00000455569
MMHTTSYRRLSPPHLTDQPSAYSHTHRTFSHFSCGSQPAAQRLHVELWNADLQSEFLCPCLGLTLYLTCNPQLGKRKFCSHSSEDMSKMVSRRNVKD

SEQ ID NO: 11471 - protein, 77 aa, Homo sapiens
  Payload ID: 2246
  Gene Symbol: CT62
  Gene Name: cancer/testis antigen 62
  ENSP ID: ENSP00000456091
MMHTTSYRRLSPPHLTDQPSAYSHTHRTFSHFSCGSQPAAQRLHVVRAPKSLRNEWLTAESNLLGVQGMWNWNKSNV

SEQ ID NO: 11472 - protein, 103 aa, Homo sapiens
  Payload ID: 2246
  Gene Symbol: CT62
  Gene Name: cancer/testis antigen 62
  ENSP ID: ENSP00000477026
  MOD_RES (1)..(1): Any amino acid
XELWNADLQSEFLCPCLGLTLYLTCNPQLGKRKFCSHSSEDMSKMVSRRNVKDSHEVSGSLQATLQPRGITRIRGCFSLGHADRRRRRGWQPPVHSLPFFFRR

SEQ ID NO: 11473 - protein, 113 aa, Homo sapiens
  Payload ID: 2247
  Gene Symbol: CT83
  Gene Name: cancer/testis antigen 83
  Uniprot ID: Q5H943
  ENSP ID: ENSP00000360961
MNFYLLLASSILCALIVFWKYRRFQRNTGEMSSNSTALALVRPSSSGLINSNTDNNLAVYDLSRDILNNFPHSIARQKRILVNLSMVENKLVELEHTLLSKGFRGASPHRKST

SEQ ID NO: 11474 - protein, 189 aa, Homo sapiens
  Payload ID: 2248
  Gene Symbol: CT45A1
  Gene Name: cancer/testis antigen family 45, member A1
  Uniprot ID: Q5HYN5
  ENSP ID: ENSP00000470185
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 11475 - protein, 189 aa, Homo sapiens; identical to SEQ ID NO: 11474
  Payload ID: 2248
  Gene Symbol: CT45A1
  Gene Name: cancer/testis antigen family 45, member A1
  Uniprot ID: Q5HYN5
  ENSP ID: ENSP00000472303

SEQ ID NO: 11476 - protein, 189 aa, Homo sapiens
  Payload ID: 2249
  Gene Symbol: CT45A10
  Gene Name: cancer/testis antigen family 45, member A10
  Uniprot ID: P0DMU9
  ENSP ID: ENSP00000481558
MTDKTEKVAVDPETVFKRPRECDSPSYQKRQRMALLARKQGAGDSLIAGSAMSKEKKLMTGHAIPPSQLDSQIDDFTGFSKDGMMQKPGSNAPVGGNVTSNFSGDDLECRGIASSPKSQQEINADIKCQVVKEIRCLGRKYEKIFEMLEGVQGPTAVRKRFFESIIKEAARCMRRDFVKHLKKKLKRMI

SEQ ID NO: 11477 - protein, 189 aa, Homo sapiens; identical to SEQ ID NO: 11476
  Payload ID: 2249
  Gene Symbol: CT45A10
  Gene Name: cancer/testis antigen family 45, member A10
  Uniprot ID: P0DMU9
  ENSP ID: ENSP00000484601

SEQ ID NO: 11478 - protein, 189 aa, Homo sapiens
  Payload ID: 2250
  Gene Symbol: CT45A2
  Gene Name: cancer/testis antigen family 45, member A2
  Uniprot ID: Q5DJT8
  ENSP ID: ENSP00000474632
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETAFSPKSQQEINADIKRQLVKELRCVGQKYEKIFEMLEGVQGPTAVRKRFFESIIKEAARCMRRDFVKHLKKKLKRMI

SEQ ID NO: 11479 - protein, 189 aa, Homo sapiens; identical to SEQ ID NO: 11478
  Payload ID: 2250
  Gene Symbol: CT45A2
  Gene Name: cancer/testis antigen family 45, member A2
  Uniprot ID: Q5DJT8
  ENSP ID: ENSP00000483619

SEQ ID NO: 11480 - protein, 189 aa, Homo sapiens
  Payload ID: 2251
  Gene Symbol: CT45A3
  Gene Name: cancer/testis antigen family 45, member A3
  Uniprot ID: Q8NHU0
  ENSP ID: ENSP00000471418
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 11481 - protein, 189 aa, Homo sapiens; identical to SEQ ID NO: 11480
  Payload ID: 2251
  Gene Symbol: CT45A3
  Gene Name: cancer/testis antigen family 45, member A3
  Uniprot ID: Q8NHU0
  ENSP ID: ENSP00000471571

SEQ ID NO: 11482 - protein, 189 aa, Homo sapiens
  Payload ID: 2252
  Gene Symbol: CT45A5
  Gene Name: cancer/testis antigen family 45, member A5
  Uniprot ID: P0DMU8
  ENSP ID: ENSP00000427342
MTDKTEKVAVDPETVFKRPRECDSPSYQKRQRMALLARKQGAGDSLIAGSAMSKEKKLMTGHAIPPSQLDSQIDDFTGFSKDGMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 11483 - protein, 189 aa, Homo sapiens; identical to SEQ ID NO: 11482
  Payload ID: 2252
  Gene Symbol: CT45A5
  Gene Name: cancer/testis antigen family 45, member A5
  Uniprot ID: P0DMU8
  ENSP ID: ENSP00000483658

SEQ ID NO: 11484 - protein, 189 aa, Homo sapiens; identical to SEQ ID NO: 11482
  Payload ID: 2253
  Gene Symbol: CT45A6
  Gene Name: cancer/testis antigen family 45, member A6
  Uniprot ID: P0DMU7
  ENSP ID: ENSP00000479608

SEQ ID NO: 11485 - protein, 189 aa, Homo sapiens; identical to SEQ ID NO: 11482
  Payload ID: 2253
  Gene Symbol: CT45A6
  Gene Name: cancer/testis antigen family 45, member A6
  Uniprot ID: P0DMU7
  ENSP ID: ENSP00000483910

SEQ ID NO: 11486 - protein, 189 aa, Homo sapiens; identical to SEQ ID NO: 11482
  Payload ID: 2254
  Gene Symbol: CT45A7
  Gene Name: cancer/testis antigen family 45, member A7
  Uniprot ID: P0DMV0
  ENSP ID: ENSP00000480765

SEQ ID NO: 11487 - protein, 189 aa, Homo sapiens; identical to SEQ ID NO: 11482
  Payload ID: 2254
  Gene Symbol: CT45A7
  Gene Name: cancer/testis antigen family 45, member A7
  Uniprot ID: P0DMV0
  ENSP ID: ENSP00000482241

SEQ ID NO: 11488 - protein, 189 aa, Homo sapiens; identical to SEQ ID NO: 11478
  Payload ID: 2255
  Gene Symbol: CT45A8
  Gene Name: cancer/testis antigen family 45, member A8
  Uniprot ID: P0DMV1
  ENSP ID: ENSP00000480644

SEQ ID NO: 11489 - protein, 189 aa, Homo sapiens; identical to SEQ ID NO: 11478
  Payload ID: 2255
  Gene Symbol: CT45A8
  Gene Name: cancer/testis antigen family 45, member A8
  Uniprot ID: P0DMV1
  ENSP ID: ENSP00000481184

SEQ ID NO: 11490 - protein, 189 aa, Homo sapiens; identical to SEQ ID NO: 11478
  Payload ID: 2256
  Gene Symbol: CT45A9
  Gene Name: cancer/testis antigen family 45, member A9
  Uniprot ID: P0DMV2
  ENSP ID: ENSP00000475060

SEQ ID NO: 11491 - protein, 189 aa, Homo sapiens; identical to SEQ ID NO: 11478
  Payload ID: 2256
  Gene Symbol: CT45A9
  Gene Name: cancer/testis antigen family 45, member A9
  Uniprot ID: P0DMV2
  ENSP ID: ENSP00000483637

SEQ ID NO: 11492 - protein, 288 aa, Homo sapiens
  Payload ID: 2257
  Gene Symbol: CT47A1
  Gene Name: cancer/testis antigen family 47, member A1
  Uniprot ID: Q5JQC4
  ENSP ID: ENSP00000393315
MSATGDRHPTQGDQEAPVSQEGAQAEAAGAGNQEGGDSGPDSSDVVPAAEVVGVAGPVEGLGEEEGEQAAGLAAVPRGGSAEEDSDIGPATEEEEEEEGNEAANFDLAVVARRYPASGIHFVLLDMVHSLLHRLSHNDHILIENRQLSRLMVGPHAAARNLWGNLPPLLLPQRLGAGAAARAGEGLGLIQEAASVPEPAVPADLAEMAREPAEEAAEEKLSEEATEEPDAEEPATEEPTAQEATAPEEVTKSQPEKWDEEAQDAAGEEEKEQEKEKDAENKVKNSKGT

SEQ ID NO: 11493 - protein, 288 aa, Homo sapiens; identical to SEQ ID NO: 11492
  Payload ID: 2258
  Gene Symbol: CT47A10
  Gene Name: cancer/testis antigen family 47, member A10
  Uniprot ID: Q5JQC4
  ENSP ID: ENSP00000411909

SEQ ID NO: 11494 - protein, 288 aa, Homo sapiens; identical to SEQ ID NO: 11492
  Payload ID: 2259
  Gene Symbol: CT47A11
  Gene Name: cancer/testis antigen family 47, member A11
  Uniprot ID: Q5JQC4
  ENSP ID: ENSP00000410400

SEQ ID NO: 11495 - protein, 288 aa, Homo sapiens; identical to SEQ ID NO: 11492
  Payload ID: 2260
  Gene Symbol: CT47A12
  Gene Name: cancer/testis antigen family 47, member A12
  Uniprot ID: Q5JQC4
  ENSP ID: ENSP00000391318

SEQ ID NO: 11496 - protein, 288 aa, Homo sapiens; identical to SEQ ID NO: 11492
  Payload ID: 2261
  Gene Symbol: CT47A2
  Gene Name: cancer/testis antigen family 47, member A2
  Uniprot ID: Q5JQC4
  ENSP ID: ENSP00000414253

SEQ ID NO: 11497 - protein, 288 aa, Homo sapiens; identical to SEQ ID NO: 11492
  Payload ID: 2262
  Gene Symbol: CT47A3
  Gene Name: cancer/testis antigen family 47, member A3
  Uniprot ID: Q5JQC4
  ENSP ID: ENSP00000398559

SEQ ID NO: 11498 - protein, 288 aa, Homo sapiens; identical to SEQ ID NO: 11492
  Payload ID: 2263
  Gene Symbol: CT47A4
  Gene Name: cancer/testis antigen family 47, member A4
  Uniprot ID: Q5JQC4
  ENSP ID: ENSP00000389513

SEQ ID NO: 11499 - protein, 288 aa, Homo sapiens; identical to SEQ ID NO: 11492
  Payload ID: 2264
  Gene Symbol: CT47A5
  Gene Name: cancer/testis antigen family 47, member A5
  Uniprot ID: Q5JQC4
  ENSP ID: ENSP00000390070

SEQ ID NO: 11500 - protein, 288 aa, Homo sapiens; identical to SEQ ID NO: 11492
  Payload ID: 2264
  Gene Symbol: CT47A5
  Gene Name: cancer/testis antigen family 47, member A5
  Uniprot ID: Q5JQC4
  ENSP ID: ENSP00000414509

SEQ ID NO: 11501 - protein, 288 aa, Homo sapiens; identical to SEQ ID NO: 11492
  Payload ID: 2265
  Gene Symbol: CT47A6
  Gene Name: cancer/testis antigen family 47, member A6
  Uniprot ID: Q5JQC4
  ENSP ID: ENSP00000399711

SEQ ID NO: 11502 - protein, 288 aa, Homo sapiens; identical to SEQ ID NO: 11492
  Payload ID: 2265
  Gene Symbol: CT47A6
  Gene Name: cancer/testis antigen family 47, member A6
  Uniprot ID: Q5JQC4
  ENSP ID: ENSP00000478317

SEQ ID NO: 11503 - protein, 288 aa, Homo sapiens; identical to SEQ ID NO: 11492
  Payload ID: 2266
  Gene Symbol: CT47A7
  Gene Name: cancer/testis antigen family 47, member A7
  Uniprot ID: Q5JQC4
  ENSP ID: ENSP00000392283

SEQ ID NO: 11504 - protein, 288 aa, Homo sapiens; identical to SEQ ID NO: 11492
  Payload ID: 2267
  Gene Symbol: CT47A8
  Gene Name: cancer/testis antigen family 47, member A8
  Uniprot ID: Q5JQC4
  ENSP ID: ENSP00000400046

SEQ ID NO: 11505 - protein, 288 aa, Homo sapiens; identical to SEQ ID NO: 11492
  Payload ID: 2267
  Gene Symbol: CT47A8
  Gene Name: cancer/testis antigen family 47, member A8
  Uniprot ID: Q5JQC4
  ENSP ID: ENSP00000487301

SEQ ID NO: 11506 - protein, 288 aa, Homo sapiens; identical to SEQ ID NO: 11492
  Payload ID: 2268
  Gene Symbol: CT47A9
  Gene Name: cancer/testis antigen family 47, member A9
  Uniprot ID: Q5JQC4
  ENSP ID: ENSP00000408204

SEQ ID NO: 11507 - protein, 299 aa, Homo sapiens
  Payload ID: 2269
  Gene Symbol: CT47B1
  Gene Name: cancer/testis antigen family 47, member B1
  Uniprot ID: P0C2W7
  ENSP ID: ENSP00000360360
MSATGDRHPTQGDQEAPVSQEGAQAEAAGAGNQEGGDSGPDSSDMVPAAEVVGVAGPVEGLGEEEGEQAAGLAAVPQGGSAEEDSDIGPATEEEEEEEEGNEAANFDLAVATRRYPAAGIGFVFLYLVHSLLRRLYHNDHIQIANRHLSRLMVGPHAAVPNLWDNPPLLLLSQRLGAGAAAPEGEGLGLIQEAASVQEAASVPEPAVPADLAEMAREPAEEAADEKPPEEAAEEKLTEEATEEPAAEEPTSEEAVAPEEVTKSQPEKWDEEAQDAAGEEEKEQEKEKDVENKVKNSKGT

SEQ ID NO: 11508 - protein, 36 aa, Homo sapiens
  Payload ID: 2270
  Gene Symbol: CNR1
  Gene Name: cannabinoid receptor 1 (brain)
  ENSP ID: ENSP00000355418
MKSILDGLADTTFRTITTDLLYVGSNDIQYEDIKGE

SEQ ID NO: 11509 - protein, 472 aa, Homo sapiens
  Payload ID: 2270
  Gene Symbol: CNR1
  Gene Name: cannabinoid receptor 1 (brain)
  Uniprot ID: P21554
  ENSP ID: ENSP00000358511
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 11510 - protein, 472 aa, Homo sapiens; identical to SEQ ID NO: 11509
  Payload ID: 2270
  Gene Symbol: CNR1
  Gene Name: cannabinoid receptor 1 (brain)
  Uniprot ID: P21554
  ENSP ID: ENSP00000358513

SEQ ID NO: 11511 - protein, 472 aa, Homo sapiens; identical to SEQ ID NO: 11509
  Payload ID: 2270
  Gene Symbol: CNR1
  Gene Name: cannabinoid receptor 1 (brain)
  Uniprot ID: P21554
  ENSP ID: ENSP00000412192

SEQ ID NO: 11512 - protein, 439 aa, Homo sapiens
  Payload ID: 2270
  Gene Symbol: CNR1
  Gene Name: cannabinoid receptor 1 (brain)
  Uniprot ID: P21554
  ENSP ID: ENSP00000420188
MKSILDGLADTTFRTITTDLLGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 11513 - protein, 78 aa, Homo sapiens
  Payload ID: 2270
  Gene Symbol: CNR1
  Gene Name: cannabinoid receptor 1 (brain)
  ENSP ID: ENSP00000446702
MKSILDGLADTTFRTITTDLLYVGSNDIQYEDIKGDMASKLGYFPQKFPLTSFRGSPFQEKMTAGDNPQLVPADQVNI

SEQ ID NO: 11514 - protein, 472 aa, Homo sapiens; identical to SEQ ID NO: 11509
  Payload ID: 2270
  Gene Symbol: CNR1
  Gene Name: cannabinoid receptor 1 (brain)
  Uniprot ID: P21554
  ENSP ID: ENSP00000446819

SEQ ID NO: 11515 - protein, 360 aa, Homo sapiens
  Payload ID: 2271
  Gene Symbol: CNR2
  Gene Name: cannabinoid receptor 2 (macrophage)
  Uniprot ID: P34972
  ENSP ID: ENSP00000363596
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 11516 - protein, 164 aa, Homo sapiens
  Payload ID: 2272
  Gene Symbol: CNRIP1
  Gene Name: cannabinoid receptor interacting protein 1
  Uniprot ID: Q96F85
  ENSP ID: ENSP00000263655
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPFTDIGTFETVWQVKFYNYHKRDHCQWGSPFSVIEYECKPNETRSLMWVNKESFL

SEQ ID NO: 11517 - protein, 137 aa, Homo sapiens
  Payload ID: 2272
  Gene Symbol: CNRIP1
  Gene Name: cannabinoid receptor interacting protein 1
  ENSP ID: ENSP00000386544
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPVRLACGYRSMVPWKMETTEKKTITISL

SEQ ID NO: 11518 - protein, 128 aa, Homo sapiens
  Payload ID: 2272
  Gene Symbol: CNRIP1
  Gene Name: cannabinoid receptor interacting protein 1
  Uniprot ID: Q96F85
  ENSP ID: ENSP00000386883
MGDLPGLVRLSIALRIQPNDGPVFYKVDGQRFGQNRTIKLLTGSSYKVEVKIKPSTLQVENISIGGVLVPLELKSKEPDGDRVVYTGTYDTEGVTPTKSGERQPIQITMPECLEQRPQEISLTYECEE

SEQ ID NO: 11519 - protein, 92 aa, Homo sapiens
  Payload ID: 2273
  Gene Symbol: CNPY1
  Gene Name: canopy FGF signaling regulator 1
  Uniprot ID: Q3B7I2
  ENSP ID: ENSP00000317439
MNDYKLEEDPVTKERTFKRFAPRKGDKIYQEFKKLYFYSDAYRPLKFACETIIEEYEDEISSLIAQETHYLADKLCSEKSDLCETSANHTEL

SEQ ID NO: 11520 - protein, 92 aa, Homo sapiens; identical to SEQ ID NO: 11519
  Payload ID: 2273
  Gene Symbol: CNPY1
  Gene Name: canopy FGF signaling regulator 1
  Uniprot ID: Q3B7I2
  ENSP ID: ENSP00000384514

SEQ ID NO: 11521 - protein, 182 aa, Homo sapiens
  Payload ID: 2274
  Gene Symbol: CNPY2
  Gene Name: canopy FGF signaling regulator 2
  Uniprot ID: Q9Y2B0
  ENSP ID: ENSP00000273308
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 11522 - protein, 102 aa, Homo sapiens
  Payload ID: 2274
  Gene Symbol: CNPY2
  Gene Name: canopy FGF signaling regulator 2
  ENSP ID: ENSP00000446784
MGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSR

SEQ ID NO: 11523 - protein, 80 aa, Homo sapiens
  Payload ID: 2274
  Gene Symbol: CNPY2
  Gene Name: canopy FGF signaling regulator 2
  ENSP ID: ENSP00000448333
KNYVRVVGRNGESSELDLQGIRIDSDISGTLKFACESIVEEYEDELIEFFSREADNVKDKLCSKRTDLCDHALHISHDEL

SEQ ID NO: 11524 - protein, 168 aa, Homo sapiens
  Payload ID: 2274
  Gene Symbol: CNPY2
  Gene Name: canopy FGF signaling regulator 2
  ENSP ID: ENSP00000448809
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRT

SEQ ID NO: 11525 - protein, 41 aa, Homo sapiens
  Payload ID: 2274
  Gene Symbol: CNPY2
  Gene Name: canopy FGF signaling regulator 2
  ENSP ID: ENSP00000449444
  MOD_RES (1)..(1): Any amino acid
XACRALVDELEWEIAQVDPKKTIQMGSFRINPDGSQSVVER

SEQ ID NO: 11526 - protein, 278 aa, Homo sapiens [sequence omitted]

SEQ ID NO: 11527 - protein, 143 aa, Homo sapiens
  Payload ID: 2275
  Gene Symbol: CNPY3
  Gene Name: canopy FGF signaling regulator 3
  ENSP ID: ENSP00000377698
MDSMPEPASRCLLLLPLLLLLLLLLPAPELGPSQAGAEENDWVRLPSKCEVCKYVAVELKSAFEETGKTKEVIGTGYGILDQKASGVKYTKSDLRLIEVTETICKRLLIIACTRRGPAAIDLPRACQRPLRHYTTWYTKGSRW

SEQ ID NO: 11528 - protein, 248 aa, Homo sapiens
  Payload ID: 2276
  Gene Symbol: CNPY4
  Gene Name: canopy FGF signaling regulator 4
  Uniprot ID: Q8N129
  ENSP ID: ENSP00000262932
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 11529 - protein, 36 aa, Homo sapiens
  Payload ID: 2276
  Gene Symbol: CNPY4
  Gene Name: canopy FGF signaling regulator 4
  ENSP ID: ENSP00000488362
MATLKGLVQKGVKVDLGIPLELWDEPSVEVTYLKKQ

SEQ ID NO: 11530 - protein, 118 aa, Homo sapiens
  Payload ID: 2276
  Gene Symbol: CNPY4
  Gene Name: canopy FGF signaling regulator 4
  ENSP ID: ENSP00000488873
  MOD_RES (1)..(1): Any amino acid
XCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQSG

SEQ ID NO: 11531 - protein, 835 aa, Homo sapiens
  Payload ID: 2277
  Gene Symbol: CMTR1
  Gene Name: cap methyltransferase 1
  Uniprot ID: Q8N1G2
  ENSP ID: ENSP00000362550
MKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 11532 - protein, 156 aa, Homo sapiens
  Payload ID: 2277
  Gene Symbol: CMTR1
  Gene Name: cap methyltransferase 1
  ENSP ID: ENSP00000393893
  MOD_RES (1)..(1): Any amino acid
XGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHLPSLACLSKMD

SEQ ID NO: 11533 - protein, 372 aa, Homo sapiens
  Payload ID: 2277
  Gene Symbol: CMTR1
  Gene Name: cap methyltransferase 1
  ENSP ID: ENSP00000414233
MKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVC

SEQ ID NO: 11534 - protein, 113 aa, Homo sapiens
  Payload ID: 2277
  Gene Symbol: CMTR1
  Gene Name: cap methyltransferase 1
  ENSP ID: ENSP00000432114
  MOD_RES (1)..(1): Any amino acid
XGSEQKFLIGLGKSQIYTWDGRQSDRWIKLDLKTELPRDTLLSVEIVHELKGEGKAQRKISAIHILDVLVLNGTDVREQHFNQRSDLGPRVGRVGVGQGSLGGQRPPEVWPLI

SEQ ID NO: 11535 - protein, 770 aa, Homo sapiens
  Payload ID: 2278
  Gene Symbol: CMTR2
  Gene Name: cap methyltransferase 2
  Uniprot ID: Q8IYT2
  ENSP ID: ENSP00000337512
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLKSHRFPCHWSWVANTLNPYHEANDDLMMIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNFGTEMKRKALFPHHVIPDSFLKRHEECCVFFHKYQLETISENIRLFECMGKAEQEKLNNLRDCAIQYFMQKFQLKHLSRNNWLVKKSSIGCSTNTKWFGQRNKYFKTYNERKMLEALSWKDKVAKGYFNSWAEEHGVYHPGQSSILEGTASNLECHLWHILEGKKLPKVKCSPFCNGEILKTLNEAIEKSLGGAFNLDSKFRPKQQYSCSCHVFSEELIFSELCSLTECLQDEQVVVPSNQIKCLLVGFSTLRNIKMHIPLEVRLLESAELTTFSCSLLHDGDPTYQRLFLDCLLHSLRELHTGDVMILPVLSCFTRFMAGLIFVLHSCFRFITFVCPTSSDPLRTCAVLLCVGYQDLPNPVFRYLQSVNELLSTLLNSDSPQQVLQFVPMEVLLKGALLDFLWDLNAAIAKRHLHFIIQREREEIINSLQLQN

SEQ ID NO: 11536 - protein, 770 aa, Homo sapiens; identical to SEQ ID NO: 11535
  Payload ID: 2278
  Gene Symbol: CMTR2
  Gene Name: cap methyltransferase 2
  Uniprot ID: Q8IYT2
  ENSP ID: ENSP00000411148

SEQ ID NO: 11537 - protein, 105 aa, Homo sapiens
  Payload ID: 2278
  Gene Symbol: CMTR2
  Gene Name: cap methyltransferase 2
  ENSP ID: ENSP00000455080
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKS

SEQ ID NO: 11538 - protein, 158 aa, Homo sapiens
  Payload ID: 2278
  Gene Symbol: CMTR2
  Gene Name: cap methyltransferase 2
  ENSP ID: ENSP00000456036
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYL

SEQ ID NO: 11539 - protein, 132 aa, Homo sapiens
  Payload ID: 2278
  Gene Symbol: CMTR2
  Gene Name: cap methyltransferase 2
  ENSP ID: ENSP00000456476
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEA

SEQ ID NO: 11540 - protein, 159 aa, Homo sapiens
  Payload ID: 2278
  Gene Symbol: CMTR2
  Gene Name: cap methyltransferase 2
  ENSP ID: ENSP00000457399
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLK

SEQ ID NO: 11541 - protein, 90 aa, Homo sapiens
  Payload ID: 2278
  Gene Symbol: CMTR2
  Gene Name: cap methyltransferase 2
  ENSP ID: ENSP00000457679
MSKCRKTPVQQLASPASFSPDILADIFELFAKNFSYGKPLNNEWQLPDPSEIFTCDHTELNAFLDLKNSLNEVKNLLSDKKLDEWHEHTA

SEQ ID NO: 11542 - protein, 340 aa, Homo sapiens
  Payload ID: 2278
  Gene Symbol: CMTR2
  Gene Name: cap methyltransferase 2
  ENSP ID: ENSP00000481621
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLKSHRFPCHWSWVANTLNPYHEANDDLMMIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNLGLK

SEQ ID NO: 11543 - protein, 770 aa, Homo sapiens
  Payload ID: 2278
  Gene Symbol: CMTR2
  Gene Name: Cap methyltransferase 2
  ENSP ID: ENSP00000489435
MSKCRKTPVQQLASPASFSPDILADIFELFAKNFSYGKPLNNEWQLPDPSEIFTCDHTEFNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLKSHRFPCHWSWVANTLNPYHEANDDLMMIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNFGTEMKRKALFPHHVIPDSFLKRHEECCVFFHKYQLETISENIRLFECMGKAEQEKLNNLRDCAIQYFMQKFQLKHLSRNNWLVKKSSIGCSTNTKWFGQRNKYFKTYNERKMLEALSWKDKVAKGYFNSWAEEHGVYHPGQSSILEGTASNLECHLWHILEGKKLPKVKCSPFCNGEILKTLNEAIEKSLGGAFNLDSKFRPKQQYSCSCHVFSEELIFSELCSLTECLQDEQVVVPSNQIKCLLVGFSTLRNIKMHIPLEVRLLESAELKTFSCSLLHDGDPTYQRLFLDCLLHSLRELHTGDVMILPVLSCFTRFMAGLIFVLHSCFRFITFVCPTSSDPLRTCAVLLCVGYQDLPNPVFRYLQSVNELLSTLLNSDSPQQVLQFVPMEVLLKGALLDFLWDLNAAIAKRHLHFIIQREREEIINSLQLQN

SEQ ID NO: 11544 - protein, 474 aa, Homo sapiens
  Payload ID: 2279
  Gene Symbol: CAP1
  Gene Name: CAP, adenylate cyclase-associated protein 1 (yeast)
  Uniprot ID: Q01518
  ENSP ID: ENSP00000344832
MADMQNLVERLERAVGRLEAVSHTSDMHRGYADSPSKGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 11545 - protein, 475 aa, Homo sapiens
  Payload ID: 2279
  Gene Symbol: CAP1
  Gene Name: CAP, adenylate cyclase-associated protein 1 (yeast)
  Uniprot ID: Q01518
  ENSP ID: ENSP00000361878
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVRSGPKPFSAPKPQTSPSPKRATKKEPAVLELEGKKWRVENQENVSNLVIEDTELKQVAYIYKCVNTTLQIKGKINSITVDNCKKLGLVFDDVVGIVEIINSKDVKVQVMGKVPTISINKTDGCHAYLSKNSLDCEIVSAKSSEMNVLIPTEGGDFNEFPVPEQFKTLWNGQKLVTTVTEIAG

SEQ ID NO: 11546 - protein, 475 aa, Homo sapiens; identical to SEQ ID NO: 11545
  Payload ID: 2279
  Gene Symbol: CAP1
  Gene Name: CAP, adenylate cyclase-associated protein 1 (yeast)
  Uniprot ID: Q01518
  ENSP ID: ENSP00000361883

SEQ ID NO: 11547 - protein, 474 aa, Homo sapiens; identical to SEQ ID NO: 11544
  Payload ID: 2279
  Gene Symbol: CAP1
  Gene Name: CAP, adenylate cyclase-associated protein 1 (yeast)
  Uniprot ID: Q01518
  ENSP ID: ENSP00000361884

SEQ ID NO: 11548 - protein, 474 aa, Homo sapiens; identical to SEQ ID NO: 11544
  Payload ID: 2279
  Gene Symbol: CAP1
  Gene Name: CAP, adenylate cyclase-associated protein 1 (yeast)
  Uniprot ID: Q01518
  ENSP ID: ENSP00000361888

SEQ ID NO: 11549 - protein, 475 aa, Homo sapiens; identical to SEQ ID NO: 11545
  Payload ID: 2279
  Gene Symbol: CAP1
  Gene Name: CAP, adenylate cyclase-associated protein 1 (yeast)
  Uniprot ID: Q01518
  ENSP ID: ENSP00000361891

SEQ ID NO: 11550 - protein, 58 aa, Homo sapiens
  Payload ID: 2279
  Gene Symbol: CAP1
  Gene Name: CAP, adenylate cyclase-associated protein 1 (yeast)
  ENSP ID: ENSP00000389974
MADMQNLVERLERAVGRLEAVSHTSDMHRGYADSPSKAGAAPYVQAFDSLLAGPVAEY

SEQ ID NO: 11551 - protein, 174 aa, Homo sapiens
  Payload ID: 2279
  Gene Symbol: CAP1
  Gene Name: CAP, adenylate cyclase-associated protein 1 (yeast)
  ENSP ID: ENSP00000398475
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKD

SEQ ID NO: 11552 - protein, 145 aa, Homo sapiens
  Payload ID: 2279
  Gene Symbol: CAP1
  Gene Name: CAP, adenylate cyclase-associated protein 1 (yeast)
  ENSP ID: ENSP00000398877
MADMQNLVERLERAVGRLEAVSHTSDMHRGYADSPSKAGAAPYVQAYIKEFHTTGLAWSKTGPVAKELSGLPSGPSAGSCPPPPPPCPPPPPVSTISCSYESASRSSLFAQINQGESITHALKHVSDDMKTHKNPALKAQSGPVR

SEQ ID NO: 11553 - protein, 176 aa, Homo sapiens
  Payload ID: 2279
  Gene Symbol: CAP1
  Gene Name: CAP, adenylate cyclase-associated protein 1 (yeast)
  ENSP ID: ENSP00000400943
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVD

SEQ ID NO: 11554 - protein, 203 aa, Homo sapiens
  Payload ID: 2279
  Gene Symbol: CAP1
  Gene Name: CAP, adenylate cyclase-associated protein 1 (yeast)
  ENSP ID: ENSP00000403198
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTT

SEQ ID NO: 11555 - protein, 208 aa, Homo sapiens
  Payload ID: 2279
  Gene Symbol: CAP1
  Gene Name: CAP, adenylate cyclase-associated protein 1 (yeast)
  ENSP ID: ENSP00000408561
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWS

SEQ ID NO: 11556 - protein, 179 aa, Homo sapiens
  Payload ID: 2279
  Gene Symbol: CAP1
  Gene Name: CAP, adenylate cyclase-associated protein 1 (yeast)
  ENSP ID: ENSP00000410586
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKH

SEQ ID NO: 11557 - protein, 262 aa, Homo sapiens
  Payload ID: 2279
  Gene Symbol: CAP1
  Gene Name: CAP, adenylate cyclase-associated protein 1 (yeast)
  ENSP ID: ENSP00000412859
MADMQNLVERLERAVGRLEAVSHTSDMHRGYADSPSKGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSCPPPPPPCPPPPPVSTISCSYESASRSSLFAQINQ

SEQ ID NO: 11558 - protein, 201 aa, Homo sapiens
  Payload ID: 2279
  Gene Symbol: CAP1
  Gene Name: CAP, adenylate cyclase-associated protein 1 (yeast)
  ENSP ID: ENSP00000413383
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFH

SEQ ID NO: 11559 - protein, 215 aa, Homo sapiens
  Payload ID: 2279
  Gene Symbol: CAP1
  Gene Name: CAP, adenylate cyclase-associated protein 1 (yeast)
  ENSP ID: ENSP00000413656
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAK

SEQ ID NO: 11560 - protein, 477 aa, Homo sapiens
  Payload ID: 2280
  Gene Symbol: CAP2
  Gene Name: CAP, adenylate cyclase-associated protein, 2 (yeast)
  Uniprot ID: P40123
  ENSP ID: ENSP00000229922
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11561 - protein, 451 aa, Homo sapiens
  Payload ID: 2280
  Gene Symbol: CAP2
  Gene Name: CAP, adenylate cyclase-associated protein, 2 (yeast)
  ENSP ID: ENSP00000368275
MANMQGLVERLERAVSRLESLSAESHRPPGNCGEVNGVIAGVAPSVEAFDKLMDSMVAEFLKNSRILAGDVETHNDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11562 - protein, 217 aa, Homo sapiens
  Payload ID: 2280
  Gene Symbol: CAP2
  Gene Name: CAP, adenylate cyclase-associated protein, 2 (yeast)
  Uniprot ID: P40123
  ENSP ID: ENSP00000417208
MANMQGLVERLERAVSRLESLSAESHRPPGNCGEVNGVIAGVAPSVEAFDKLMDSMVAEFLKNSRILAGDVETHEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11563 - protein, 365 aa, Homo sapiens
  Payload ID: 2280
  Gene Symbol: CAP2
  Gene Name: CAP, adenylate cyclase-associated protein, 2 (yeast)
  ENSP ID: ENSP00000417705
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHEGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11564 - protein, 413 aa, Homo sapiens
  Payload ID: 2280
  Gene Symbol: CAP2
  Gene Name: CAP, adenylate cyclase-associated protein, 2 (yeast)
  Uniprot ID: P40123
  ENSP ID: ENSP00000418604
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11565 - protein, 104 aa, Homo sapiens
  Payload ID: 2280
  Gene Symbol: CAP2
  Gene Name: CAP, adenylate cyclase-associated protein, 2 (yeast)
  ENSP ID: ENSP00000419906
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHEANKF

SEQ ID NO: 11566 - protein, 194 aa, Homo sapiens
  Payload ID: 2280
  Gene Symbol: CAP2
  Gene Name: CAP, adenylate cyclase-associated protein, 2 (yeast)
  ENSP ID: ENSP00000420615
MANMQGLVERLERAVSRLESLSAESHRPPGNCGEVNGVIAGVAPSVEAFDKLMDSMVAEFLKNSRILAGDVETHNDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTNEKRRRQR

SEQ ID NO: 11567 - protein, 394 aa, Homo sapiens
  Payload ID: 2280
  Gene Symbol: CAP2
  Gene Name: CAP, adenylate cyclase-associated protein, 2 (yeast)
  ENSP ID: ENSP00000482279
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11568 - protein, 394 aa, Homo sapiens
  Payload ID: 2280
  Gene Symbol: CAP2
  Gene Name: CAP, adenylate cyclase-associated protein, 2 (yeast)
  ENSP ID: ENSP00000483435
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 11569 - protein, 1427 aa, Homo sapiens
  Payload ID: 2281
  Gene Symbol: CLIP1
  Gene Name: CAP-GLY domain containing linker protein 1
  Uniprot ID: P30622
  ENSP ID: ENSP00000303585
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 11570 - protein, 1427 aa, Homo sapiens; identical to SEQ ID NO: 11569
  Payload ID: 2281
  Gene Symbol: CLIP1
  Gene Name: CAP-GLY domain containing linker protein 1
  Uniprot ID: P30622
  ENSP ID: ENSP00000351665

SEQ ID NO: 11571 - protein, 1316 aa, Homo sapiens
  Payload ID: 2281
  Gene Symbol: CLIP1
  Gene Name: CAP-GLY domain containing linker protein 1
  ENSP ID: ENSP00000355314
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 11572 - protein, 117 aa, Homo sapiens
  Payload ID: 2281
  Gene Symbol: CLIP1
  Gene Name: CAP-GLY domain containing linker protein 1
  ENSP ID: ENSP00000437617
MIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 11573 - protein, 803 aa, Homo sapiens
  Payload ID: 2281
  Gene Symbol: CLIP1
  Gene Name: CAP-GLY domain containing linker protein 1
  ENSP ID: ENSP00000437786
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKER

SEQ ID NO: 11574 - protein, 1013 aa, Homo sapiens
  Payload ID: 2281
  Gene Symbol: CLIP1
  Gene Name: CAP-GLY domain containing linker protein 1
  ENSP ID: ENSP00000438743
MATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 11575 - protein, 1438 aa, Homo sapiens
  Payload ID: 2281
  Gene Symbol: CLIP1
  Gene Name: CAP-GLY domain containing linker protein 1
  Uniprot ID: P30622
  ENSP ID: ENSP00000439093
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEQKSQISEDPENTQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 11576 - protein, 108 aa, Homo sapiens
  Payload ID: 2281
  Gene Symbol: CLIP1
  Gene Name: CAP-GLY domain containing linker protein 1
  ENSP ID: ENSP00000439472
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRY

SEQ ID NO: 11577 - protein, 428 aa, Homo sapiens
  Payload ID: 2281
  Gene Symbol: CLIP1
  Gene Name: CAP-GLY domain containing linker protein 1
  ENSP ID: ENSP00000441409
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLHVLELEAKMDQLRTMVEAADREKVELLNQLEEEKRKVEDLQFRVEEESITKGDLEQKSQISEDPENVRGHLTVWIFPLLTKIDHRLKCLLIYS

SEQ ID NO: 11578 - protein, 83 aa, Homo sapiens
  Payload ID: 2281
  Gene Symbol: CLIP1
  Gene Name: CAP-GLY domain containing linker protein 1
  ENSP ID: ENSP00000445387
MSMLKPSGLKAPTKILKPGSTALKTPTAVVAPVEKTISSEKASSTPSSETQEEFVDDFRVGERVWVNGNKPGFIQFLGETQFA

SEQ ID NO: 11579 - protein, 1392 aa, Homo sapiens
  Payload ID: 2281
  Gene Symbol: CLIP1
  Gene Name: CAP-GLY domain containing linker protein 1
  Uniprot ID: P30622
  ENSP ID: ENSP00000445531
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 11580 - protein, 350 aa, Homo sapiens
  Payload ID: 2281
  Gene Symbol: CLIP1
  Gene Name: CAP-GLY domain containing linker protein 1
  ENSP ID: ENSP00000446379
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLVRPLSHYLPPLPRQD

SEQ ID NO: 11581 - protein, 1438 aa, Homo sapiens; identical to SEQ ID NO: 11575
  Payload ID: 2281
  Gene Symbol: CLIP1
  Gene Name: CAP-GLY domain containing linker protein 1
  Uniprot ID: P30622
  ENSP ID: ENSP00000479322

SEQ ID NO: 11582 - protein, 1046 aa, Homo sapiens
  Payload ID: 2282
  Gene Symbol: CLIP2
  Gene Name: CAP-GLY domain containing linker protein 2
  Uniprot ID: Q9UDT6
  ENSP ID: ENSP00000223398
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDRSSAPELLRLQHQLMSTEDALRDALDQAQQVEKLMEAMRSCPDKAQTIGNSGSANGIHQQDKAQKQEDKH

SEQ ID NO: 11583 - protein, 1011 aa, Homo sapiens
  Payload ID: 2282
  Gene Symbol: CLIP2
  Gene Name: CAP-GLY domain containing linker protein 2
  Uniprot ID: Q9UDT6
  ENSP ID: ENSP00000355151
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLELTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDRSSAPELLRLQHQLMSTEDALRDALDQAQQVEKLMEAMRSCPDKAQTIGNSGSANGIHQQDKAQKQEDKH

SEQ ID NO: 11584 - protein, 1046 aa, Homo sapiens; identical to SEQ ID NO: 11582
  Payload ID: 2282
  Gene Symbol: CLIP2
  Gene Name: CAP-GLY domain containing linker protein 2
  Uniprot ID: Q9UDT6
  ENSP ID: ENSP00000378500

SEQ ID NO: 11585 - protein, 187 aa, Homo sapiens
  Payload ID: 2282
  Gene Symbol: CLIP2
  Gene Name: CAP-GLY domain containing linker protein 2
  ENSP ID: ENSP00000417597
  MOD_RES (1)..(1): Any amino acid
XYERLQRAEAQGKQEVESLREKLLVAENRLQAVEALCSSQHTHMIESNDISEETIRTKETVEGAVLASLYPLSRNILCRPAGQAEQEGQRGDSLDLPDRDAQGPTLESKCKSGEKKVDALLKEKRRLEAELETVSRKTHDASGQLVLISQELLRKERSLNELRVLLLEANRHSPGPERDLSREVHKA

SEQ ID NO: 11586 - protein, 28 aa, Homo sapiens
  Payload ID: 2282
  Gene Symbol: CLIP2
  Gene Name: CAP-GLY domain containing linker protein 2
  ENSP ID: ENSP00000419938
  MOD_RES (1)..(1): Any amino acid
XDALDQAQQVEKLMEAMRSCPDKAQDKH

SEQ ID NO: 11587 - protein, 547 aa, Homo sapiens
  Payload ID: 2283
  Gene Symbol: CLIP3
  Gene Name: CAP-GLY domain containing linker protein 3
  Uniprot ID: Q96DZ5
  ENSP ID: ENSP00000353732
MTKTDPAPMAPPPRGEEEEEEEEDEPVPEAPSPTQERRQKPVVHPSAPAPLPKDYAFTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 11588 - protein, 133 aa, Homo sapiens
  Payload ID: 2283
  Gene Symbol: CLIP3
  Gene Name: CAP-GLY domain containing linker protein 3
  ENSP ID: ENSP00000466026
MTKTDPAPMAPPPRGEEEEEEEEDEPVPEAPSPTQERRQKPVVHPSAPAPLPKDYAFTFFDPNDPACQEILFDPQTTIPELFAIVRQWVPQVQHKIDVIGNEILRRGCHVNDRDGLTDMTLLHYACKAGAHGV

SEQ ID NO: 11589 - protein, 547 aa, Homo sapiens; identical to SEQ ID NO: 11587
  Payload ID: 2283
  Gene Symbol: CLIP3
  Gene Name: CAP-GLY domain containing linker protein 3
  Uniprot ID: Q96DZ5
  ENSP ID: ENSP00000466832

SEQ ID NO: 11590 - protein, 133 aa, Homo sapiens; identical to SEQ ID NO: 11588
  Payload ID: 2283
  Gene Symbol: CLIP3
  Gene Name: CAP-GLY domain containing linker protein 3
  ENSP ID: ENSP00000468689

SEQ ID NO: 11591 - protein, 705 aa, Homo sapiens
  Payload ID: 2284
  Gene Symbol: CLIP4
  Gene Name: CAP-GLY domain containing linker protein family, member 4
  Uniprot ID: Q8N3C7
  ENSP ID: ENSP00000327009
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVRYVGPTDFASGIWLGLELRSAKGKNDGSVGDKRYFTCKPNHGVLVRPSRVTYRGINGSKLVDENC

SEQ ID NO: 11592 - protein, 599 aa, Homo sapiens
  Payload ID: 2284
  Gene Symbol: CLIP4
  Gene Name: CAP-GLY domain containing linker protein family, member 4
  Uniprot ID: Q8N3C7
  ENSP ID: ENSP00000384242
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSK

SEQ ID NO: 11593 - protein, 571 aa, Homo sapiens
  Payload ID: 2284
  Gene Symbol: CLIP4
  Gene Name: CAP-GLY domain containing linker protein family, member 4
  ENSP ID: ENSP00000385148
MTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGLNSSATSTANNSRCEGELRLGERVLVVGQRLGTIRFFGTTNFAPGYWYGIELEKPHGKNDGSVGGVQYFSCSPRYGIFAPPSRVQRVTDSLDTLSEISSNKQNHSYPGFRRSFSTTSASSQKEINRRNAFSKSKAALRRSWSSTPTAGGIEGSVKLHEGSQVLLTSSNEMGTVSMFRITGMLVLLFHATTQEPSAAMKLAKSNCVFFRDSF

SEQ ID NO: 11594 - protein, 705 aa, Homo sapiens; identical to SEQ ID NO: 11591
  Payload ID: 2284
  Gene Symbol: CLIP4
  Gene Name: CAP-GLY domain containing linker protein family, member 4
  Uniprot ID: Q8N3C7
  ENSP ID: ENSP00000385594

SEQ ID NO: 11595 - protein, 93 aa, Homo sapiens
  Payload ID: 2284
  Gene Symbol: CLIP4
  Gene Name: CAP-GLY domain containing linker protein family, member 4
  ENSP ID: ENSP00000392296
MTLLHYTCKSGAHGIGDVETAVKFATQLIDLGADISLRSRWTNMNALHYAAYFDVPELIRVILKTSKPKDVDATCSDFNFGTALHIAAYNLCA

SEQ ID NO: 11596 - protein, 214 aa, Homo sapiens
  Payload ID: 2284
  Gene Symbol: CLIP4
  Gene Name: CAP-GLY domain containing linker protein family, member 4
  ENSP ID: ENSP00000393354
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPA

SEQ ID NO: 11597 - protein, 97 aa, Homo sapiens
  Payload ID: 2284
  Gene Symbol: CLIP4
  Gene Name: CAP-GLY domain containing linker protein family, member 4
  ENSP ID: ENSP00000399029
MTIEDLPDFPLEGNPLFGRYPFIFSASDTPVIFSISAAPMPSDCEFSFFDPNDASCQEILFDPKTSVSELFAILRQWVPQVQQNIDIIGNEVMWKQL

SEQ ID NO: 11598 - protein, 495 aa, Homo sapiens
  Payload ID: 2284
  Gene Symbol: CLIP4
  Gene Name: CAP-GLY domain containing linker protein family, member 4
  ENSP ID: ENSP00000414417
MTIEDLPDFPLEGNPLFGRYPFIFSASDTPVIFSISAAPMPSDCEFSFFDPNDASCQEILFDPKTSVSELFAILRQWVPQVQQNIDIIGNEILKRGCNVNDRDGLTDMTLLHYTCKSGAHGIGDVETAVKFATQLIDLGADISLRSRWTNMNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGIYGFFNQAFLVFFILVCLFEFLSNIYSK

SEQ ID NO: 11599 - protein, 1606 aa, Homo sapiens
  Payload ID: 2285
  Gene Symbol: CIC
  Gene Name: capicua transcriptional repressor
  ENSP ID: ENSP00000160740
MYSAHRPLMPASSAASRGLGMFVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSGQAPLLAPGQVGVSPVPSPQLPPACAAPGGPVITAFYSGSPAPTSSAPLAQPSQAPPSLVYTVATSTTPPAATILPKGPPAPATATPAPTSPFPSATGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 11600 - protein, 309 aa, Homo sapiens
  Payload ID: 2285
  Gene Symbol: CIC
  Gene Name: capicua transcriptional repressor
  ENSP ID: ENSP00000458543
SSSSDWRVPGQGLENRGEPPTPPSPAPAPAVAPGGSSESSSGRAAGDTPERKEAAGTGKKVKVRPPPLKKTFDSVDKVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESG

SEQ ID NO: 11601 - protein, 1608 aa, Homo sapiens
  Payload ID: 2285
  Gene Symbol: CIC
  Gene Name: capicua transcriptional repressor
  Uniprot ID: Q96RK0
  ENSP ID: ENSP00000458663
MYSAHRPLMPASSAASRGLGMFVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSAGQAPLLAPGQVGVSPVPSPQLPPACAAPGGPVITAFYSGSPAPTSSAPLAQPSQAPPSLVYTVATSTTPPAATILPKGPPAPATATPAPTSPFPSATAGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 11602 - protein, 320 aa, Homo sapiens
  Payload ID: 2285
  Gene Symbol: CIC
  Gene Name: capicua transcriptional repressor
  ENSP ID: ENSP00000459011
  MOD_RES (1)..(1): Any amino acid
XEPPTPPSPAPAPAVAPGGSSESSSGRAAGDTPERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 11603 - protein, 144 aa, Homo sapiens
  Payload ID: 2285
  Gene Symbol: CIC
  Gene Name: capicua transcriptional repressor
  ENSP ID: ENSP00000459704
MKPMKKACTGLSGPGSGSKSPPATRAKALRRRGAGEGDKPEEEDDEAQQPQPQSGPEEAEEGEEEEAERGPGAEGPPLELHPGDPAPGPAEDPKGDGEAGRWEPSLSRKTATFKSRAPKKKYVEEHGAGSSGVAGAPEERVRTP

SEQ ID NO: 11604 - protein, 2514 aa, Homo sapiens
  Payload ID: 2285
  Gene Symbol: CIC
  Gene Name: capicua transcriptional repressor
  ENSP ID: ENSP00000459719
MKPMKKACTGLSGPGSGSKSPPATRAKALRRRGAGEGDKPEEEDDEAQQPQPQSGPEEAEEGEEEEAERGPGAEGPPLELHPGDPAPGPAEDPKGDGEAGRWEPSLSRKTATFKSRAPKKKYVEEHGAGSSGVAGAPEERVRTPEEASGLGVPPRPPTSTRSSSTDTASEHSADLEDEPAEACGPGPWPPGSTSGSYDLRQLRSQRVLARRGDGLFLPAVVRQVRRSQDLGVQFPGDRALTFYEGVPGAGVDVVLDATPPPGALVVGTAVCTCVEPGVAAYREGVVVEVATKPAAYKVRLSPGPSSQPGLPGSLPQPPQPLHREPEEAVWVARSSLRLLRPPWEPETMLRKPPTGPEEEQAEPGATLPPCPAALDPKQPEDAEVSKISFGGNLGTHCEEGEEKHPPALGTPALLPLPPPQLLSPPPKSPAFVGPGRPGEQPSPCQEGSQGGSRSSSVASLEKGTAPAARARTPLTAAQQKYKKGDVVCTPSGIRKKFNGKQWRRLCSRDGCMKESQRRGYCSRHLSMRTKEMEGLADSGPGGAGRPAAVAAREGSTEFDWGDETSRDSEASSVAARGDSRPRLVAPADLSRFEFDECEAAVMLVSLGSSRSGTPSFSPVSTQSPFSPAPSPSPSPLFGFRPANFSPINASPVIQRTAVRSRHLSASTPKAGVLTPPDLGPHPPPPAPRERHSSGILPTFQTNLTFTVPISPGRRKTELLPHPGALGAPGAGGGGAAPDFPKSDSLDSGVDSVSHTPTPSTPAGFRAVSPAVPFSRSRQPSPLLLLPPPAGLTSDPGPSVRRVPAVQRDSPVIVRNPDVPLPSKFPGEVGTAGEVRAGGPGRGCRETPVPPGVASGKPGLPPPLPAPVPITVPPAAPTAVAQPMPAFGLASSPFQPVAFHPSPAALLPVLVPSSYTSHPAPKKEVIMGRPGTVWTNVEPRSVAVFPWHSLVPFLAPSQPDPSVQPSEAQQPASHPVASNQSKEPAESAAVAHERPPGGTGSADPERPPGATCPESPGPGPPHPLGVVESGKGPPPTTEEEASGPPGEPRLDSETESDHDDAFLSIMSPEIQLPLPPGKRRTQSLSALPKERDSSSEKDGRSPNKREKDHIRRPMNAFMIFSKRHRALVHQRHPNQDNRTVSKILGEWWYALGPKEKQKYHDLAFQVKEAHFKAHPDWKWCNKDRKKSSSEAKPTSLGLAGGHKETRERSMSETGTAAAPGVSSELLSVAAQTLLSSDTKAPGSSSCGAERLHTVGGPGSARPRAFSHSGVHSLDGGEVDSQALQELTQMVSGPASYSGPKPSTQYGAPGPFAAPGEGGALAATGRPPLLPTRASRSQRAASEDMTSDEERMVICEEEGDDDVIADDGFGTTDIDLKCKERVTDSESGDSSGEDPEGNKGFGRKVFSPVIRSSFTHCRPPLDPEPPGPPDPPVAFGKGYGSAPSSSASSPASSSASAATSFSLGSGTFKAQESGQGSTAGPLRPPPPGAGGPATPSKATRFLPMDPATFRRKRPESVGGLEPPGPSVIAAPPSGGGNILQTLVLPPNKEEQEGGGARVPSAPAPSLAYGAPAAPLSRPAATMVTNVVRPVSSTPVPIASKPFPTSGRAEASPNDTAGARTEMGTGSRVPGGSPLGVSLVYSDKKSAAATSPAPHLVAGPLLGTVGKAPATVTNLLVGTPGYGAPAPPAVQFIAQGAPGGGTTAGSGAGAGSGPNGPVPLGILQPGALGKAGGITQVQYILPTLPQQLQVAPAPAPAPGTKAAAPSGPAPTTSIRFTLPPGTSTNGKVLAATAPTPGIPILQSVPSAPPPKAQSVSPVQAPPPGGSAQLLPGKVLVPLAAPSMSVRGGGAGQPLPLVSPPFSVPVQNGAQPPSKIIQLTPVPVSTPSGLVPPLSPATLPGPTSQPQKVLLPSSTRITYVQSAGGHALPLGTSPASSQAGTVTSYGPTSSVALGFTSLGPSGPAFVQPLLSGQAPLLAPGQVGVSPVPSPQLPPACAAPGGPVITAFYSGSPAPTSSAPLAQPSQAPPSLVYTVATSTTPPAATILPKGPPAPATATPAPTSPFPSATGSMTYSLVAPKAQRPSPKAPQKVKAAIASIPVGSFEAGASGRPGPAPRQPLEPGPVREPTAPESELEGQPTPPAPPPLPETWTPTARSSPPLPPPAEERTSAKGPETMASKFPSSSSDWRVPGQGLENRGEPPTPPSPAPAPAVAPGGSSESSSGRAAGDTPERKEAAGTGKKVKVRPPPLKKTFDSVDKVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTGTEAEDVLGELEYDKVPYSSLRRTLDQRRALVMQLFQDHGFFPSAQATAAFQARYADIFPSKVCLQLKIREVRQKIMQAATPTEQPPGAEAPLPVPPPTGTAAAPAPTPSPAGGPDPTSPSSDSGTAQAAPPLPPPPESGPGQPGWEGAPQPSPPPPGPSTAATGR

SEQ ID NO: 11605 - protein, 144 aa, Homo sapiens
  Payload ID: 2285
  Gene Symbol: CIC
  Gene Name: capicua transcriptional repressor
  ENSP ID: ENSP00000460230
PERKEAAGTGKKVKVRPPPLKKTFDSVDNRVLSEVDFEERFAELPEFRPEEVLPSPTLQSLATSPRAILGSYRKKRKNSTDLDSAPEDPTSPKRKMRRRSSCSSEPNTPKSAKCEGDIFTFDRTALPCCLCPAQVQKPRTCLGS

SEQ ID NO: 11606 - protein, 286 aa, Homo sapiens
  Payload ID: 2286
  Gene Symbol: CAPZA1
  Gene Name: capping protein (actin filament) muscle Z-line, alpha 1
  Uniprot ID: P52907
  ENSP ID: ENSP00000263168
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFWNGRWRSEWKFTITPPTAQVVGVLKIQVHYYEDGNVQLVSHKDVQDSLTVSNEAQTAKEFIKIIENAENEYQTAISENYQTMSDTTFKALRRQLPVTRTKIDWNKILSYKIGKEMQNA

SEQ ID NO: 11607 - protein, 286 aa, Homo sapiens
  Payload ID: 2287
  Gene Symbol: CAPZA2
  Gene Name: capping protein (actin filament) muscle Z-line, alpha 2
  Uniprot ID: P47755
  ENSP ID: ENSP00000354947
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 11608 - protein, 174 aa, Homo sapiens
  Payload ID: 2287
  Gene Symbol: CAPZA2
  Gene Name: capping protein (actin filament) muscle Z-line, alpha 2
  ENSP ID: ENSP00000395395
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFCCCFYF

SEQ ID NO: 11609 - protein, 37 aa, Homo sapiens
  Payload ID: 2287
  Gene Symbol: CAPZA2
  Gene Name: capping protein (actin filament) muscle Z-line, alpha 2
  ENSP ID: ENSP00000408150
MADLEEQLSDEEKTKSVLHFEDFESRGPGKLANFFLK

SEQ ID NO: 11610 - protein, 34 aa, Homo sapiens
  Payload ID: 2287
  Gene Symbol: CAPZA2
  Gene Name: capping protein (actin filament) muscle Z-line, alpha 2
  ENSP ID: ENSP00000418262
MPLLENLMRFSMMFGYCLIMTIFSGKEQPMHLHS

SEQ ID NO: 11611 - protein, 146 aa, Homo sapiens
  Payload ID: 2287
  Gene Symbol: CAPZA2
  Gene Name: capping protein (actin filament) muscle Z-line, alpha 2
  ENSP ID: ENSP00000419484
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVSHQ

SEQ ID NO: 11612 - protein, 34 aa, Homo sapiens; identical to SEQ ID NO: 11610
  Payload ID: 2287
  Gene Symbol: CAPZA2
  Gene Name: capping protein (actin filament) muscle Z-line, alpha 2
  ENSP ID: ENSP00000420640

SEQ ID NO: 11613 - protein, 174 aa, Homo sapiens
  Payload ID: 2287
  Gene Symbol: CAPZA2
  Gene Name: capping protein (actin filament) muscle Z-line, alpha 2
  ENSP ID: ENSP00000485993
MIDVRYQIDNKKMVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFCCCFYF

SEQ ID NO: 11614 - protein, 299 aa, Homo sapiens
  Payload ID: 2288
  Gene Symbol: CAPZA3
  Gene Name: capping protein (actin filament) muscle Z-line, alpha 3
  Uniprot ID: Q96KX2
  ENSP ID: ENSP00000326238
MTLSVLSRKDKERVIRRLLLQAPPGEFVNAFDDLCLLIRDEKLMHHQGECAGHQHCQKYSVPLCIDGNPVLLSHHNVMGDYRFFDHQSKLSFKYDLLQNQLKDIQSHGIIQNEAEYLRVVLLCALKLYVNDHYPKGNCNMLRKTVKSKEYLIACIEDHNYETGECWNGLWKSKWIFQVNPFLTQVTGRIFVQAHFFRCVNLHIEISKDLKESLEIVNQAQLALSFARLVEEQENKFQAAVLEELQELSNEALRKILRRDLPVTRTLIDWHRILSDLNLVMYPKLGYVIYSRSVLCNWII

SEQ ID NO: 11615 - protein, 272 aa, Homo sapiens
  Payload ID: 2289
  Gene Symbol: CAPZB
  Gene Name: capping protein (actin filament) muscle Z-line, beta
  Uniprot ID: P47756
  ENSP ID: ENSP00000264202
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 11616 - protein, 260 aa, Homo sapiens
  Payload ID: 2289
  Gene Symbol: CAPZB
  Gene Name: capping protein (actin filament) muscle Z-line, beta
  ENSP ID: ENSP00000264203
MPRQFQDTGFSRPGLGQPRRCDPEPRKSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEVCADFCRQIKTRSSEE

SEQ ID NO: 11617 - protein, 277 aa, Homo sapiens
  Payload ID: 2289
  Gene Symbol: CAPZB
  Gene Name: capping protein (actin filament) muscle Z-line, beta
  Uniprot ID: P47756
  ENSP ID: ENSP00000364284
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 11618 - protein, 260 aa, Homo sapiens
  Payload ID: 2289
  Gene Symbol: CAPZB
  Gene Name: capping protein (actin filament) muscle Z-line, beta
  ENSP ID: ENSP00000364286
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 11619 - protein, 301 aa, Homo sapiens
  Payload ID: 2289
  Gene Symbol: CAPZB
  Gene Name: capping protein (actin filament) muscle Z-line, beta
  ENSP ID: ENSP00000401010
MHPSRRSLPFPLNCQLARVGTADYGSPSDQSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 11620 - protein, 348 aa, Homo sapiens
  Payload ID: 2290
  Gene Symbol: CAPG
  Gene Name: capping protein (actin filament), gelsolin-like
  Uniprot ID: P40121
  ENSP ID: ENSP00000263867
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 11621 - protein, 348 aa, Homo sapiens; identical to SEQ ID NO: 11620
  Payload ID: 2290
  Gene Symbol: CAPG
  Gene Name: capping protein (actin filament), gelsolin-like
  Uniprot ID: P40121
  ENSP ID: ENSP00000386315

SEQ ID NO: 11622 - protein, 218 aa, Homo sapiens
  Payload ID: 2290
  Gene Symbol: CAPG
  Gene Name: capping protein (actin filament), gelsolin-like
  ENSP ID: ENSP00000386596
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPA

SEQ ID NO: 11623 - protein, 348 aa, Homo sapiens; identical to SEQ ID NO: 11620
  Payload ID: 2290
  Gene Symbol: CAPG
  Gene Name: capping protein (actin filament), gelsolin-like
  Uniprot ID: P40121
  ENSP ID: ENSP00000386965

SEQ ID NO: 11624 - protein, 333 aa, Homo sapiens
  Payload ID: 2290
  Gene Symbol: CAPG
  Gene Name: capping protein (actin filament), gelsolin-like
  Uniprot ID: P40121
  ENSP ID: ENSP00000387063
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGHESPIFKQFFKDWK

SEQ ID NO: 11625 - protein, 253 aa, Homo sapiens
  Payload ID: 2290
  Gene Symbol: CAPG
  Gene Name: capping protein (actin filament), gelsolin-like
  ENSP ID: ENSP00000391923
MYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYK

SEQ ID NO: 11626 - protein, 103 aa, Homo sapiens
  Payload ID: 2290
  Gene Symbol: CAPG
  Gene Name: capping protein (actin filament), gelsolin-like
  ENSP ID: ENSP00000397381
LTADKANAQAAALYKMNLTKVADSSPFALELLISDDCFVLDNGLCGKIYIWKGRKANEKERQAALQVAEGFISRMQYAPNTQVEILPQGHESPIFKQFFKDWK

SEQ ID NO: 11627 - protein, 253 aa, Homo sapiens; identical to SEQ ID NO: 11625
  Payload ID: 2290
  Gene Symbol: CAPG
  Gene Name: capping protein (actin filament), gelsolin-like
  ENSP ID: ENSP00000398232

SEQ ID NO: 11628 - protein, 253 aa, Homo sapiens; identical to SEQ ID NO: 11625
  Payload ID: 2290
  Gene Symbol: CAPG
  Gene Name: capping protein (actin filament), gelsolin-like
  ENSP ID: ENSP00000403330

SEQ ID NO: 11629 - protein, 1077 aa, Homo sapiens
  Payload ID: 2291
  Gene Symbol: CAPRIN2
  Gene Name: caprin family member 2
  Uniprot ID: Q6IMN6
  ENSP ID: ENSP00000298892
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEVFNVNAPLPPRKEQEIKESPYSPGYNQSFTTASTQTPPQCQLPSIHVEQTVHSQETANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 11630 - protein, 905 aa, Homo sapiens
  Payload ID: 2291
  Gene Symbol: CAPRIN2
  Gene Name: caprin family member 2
  Uniprot ID: Q6IMN6
  ENSP ID: ENSP00000379150
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRANCFIMRNSLLLIKQQGGVILLR

SEQ ID NO: 11631 - protein, 960 aa, Homo sapiens
  Payload ID: 2291
  Gene Symbol: CAPRIN2
  Gene Name: caprin family member 2
  Uniprot ID: Q6IMN6
  ENSP ID: ENSP00000391479
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRANCFIMRNSLLLIKQQGGVILLR

SEQ ID NO: 11632 - protein, 278 aa, Homo sapiens
  Payload ID: 2291
  Gene Symbol: CAPRIN2
  Gene Name: caprin family member 2
  Uniprot ID: Q6IMN6
  ENSP ID: ENSP00000403876
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLRQTLEGSTV

SEQ ID NO: 11633 - protein, 706 aa, Homo sapiens
  Payload ID: 2291
  Gene Symbol: CAPRIN2
  Gene Name: caprin family member 2
  ENSP ID: ENSP00000415407
IKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRCLETSEPLWLLGKARIISSSVISEEGHLVVHEQIREQGGVILLR

SEQ ID NO: 11634 - protein, 702 aa, Homo sapiens
  Payload ID: 2291
  Gene Symbol: CAPRIN2
  Gene Name: caprin family member 2
  ENSP ID: ENSP00000438010
MKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKE

SEQ ID NO: 11635 - protein, 68 aa, Homo sapiens
  Payload ID: 2291
  Gene Symbol: CAPRIN2
  Gene Name: caprin family member 2
  ENSP ID: ENSP00000440785
MLKLEAEKKKLRTILQVQYVLQNLTQEHVQKDFKGGLNGAVYLPSKELDYLIKFSKLTCPERNESLSV

SEQ ID NO: 11636 - protein, 119 aa, Homo sapiens
  Payload ID: 2291
  Gene Symbol: CAPRIN2
  Gene Name: caprin family member 2
  ENSP ID: ENSP00000441005
MKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQR

SEQ ID NO: 11637 - protein, 126 aa, Homo sapiens
  Payload ID: 2291
  Gene Symbol: CAPRIN2
  Gene Name: caprin family member 2
  ENSP ID: ENSP00000442295
MKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKL

SEQ ID NO: 11638 - protein, 174 aa, Homo sapiens
  Payload ID: 2291
  Gene Symbol: CAPRIN2
  Gene Name: caprin family member 2
  ENSP ID: ENSP00000443145
  MOD_RES (1)..(1): Any amino acid
XCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDVTTKSAKEGPEKGAHAKT

SEQ ID NO: 11639 - protein, 186 aa, Homo sapiens
  Payload ID: 2291
  Gene Symbol: CAPRIN2
  Gene Name: caprin family member 2
  ENSP ID: ENSP00000443353
MKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNE

SEQ ID NO: 11640 - protein, 84 aa, Homo sapiens
  Payload ID: 2291
  Gene Symbol: CAPRIN2
  Gene Name: caprin family member 2
  ENSP ID: ENSP00000444137
MLKLEAEKKKLRTILQVQYVLQNLTQEHVQKDFKGGLNGAVYLPSKELDYLIKFSKLTCPERNESLSVEDQMEQSSLYFWDLLE

SEQ ID NO: 11641 - protein, 135 aa, Homo sapiens
  Payload ID: 2291
  Gene Symbol: CAPRIN2
  Gene Name: caprin family member 2
  ENSP ID: ENSP00000449139
EDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLRQTLEGSTV

SEQ ID NO: 11642 - protein, 1500 aa, Homo sapiens
  Payload ID: 2292
  Gene Symbol: CPS1
  Gene Name: carbamoyl-phosphate synthase 1, mitochondrial
  Uniprot ID: P31327
  ENSP ID: ENSP00000233072
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 11643 - protein, 121 aa, Homo sapiens
  Payload ID: 2292
  Gene Symbol: CPS1
  Gene Name: carbamoyl-phosphate synthase 1, mitochondrial
  ENSP ID: ENSP00000388496
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYL

SEQ ID NO: 11644 - protein, 1506 aa, Homo sapiens
  Payload ID: 2292
  Gene Symbol: CPS1
  Gene Name: carbamoyl-phosphate synthase 1, mitochondrial
  Uniprot ID: P31327
  ENSP ID: ENSP00000402608
MPQIIKMTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 11645 - protein, 1049 aa, Homo sapiens
  Payload ID: 2292
  Gene Symbol: CPS1
  Gene Name: carbamoyl-phosphate synthase 1, mitochondrial
  Uniprot ID: P31327
  ENSP ID: ENSP00000406136
MKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 11646 - protein, 157 aa, Homo sapiens
  Payload ID: 2292
  Gene Symbol: CPS1
  Gene Name: carbamoyl-phosphate synthase 1, mitochondrial
  ENSP ID: ENSP00000430644
MPQIIKMTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQ

SEQ ID NO: 11647 - protein, 121 aa, Homo sapiens; identical to SEQ ID NO: 11643
  Payload ID: 2292
  Gene Symbol: CPS1
  Gene Name: carbamoyl-phosphate synthase 1, mitochondrial
  ENSP ID: ENSP00000430697

SEQ ID NO: 11648 - protein, 513 aa, Homo sapiens [sequence omitted]

SEQ ID NO: 11649 - protein, 2225 aa, Homo sapiens
  Payload ID: 2293
  Gene Symbol: CAD
  Gene Name: carbamoyl-phosphate synthetase 2, aspartate transcarbamylase, and dihydroorotase
  Uniprot ID: P27708
  ENSP ID: ENSP00000264705
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 11650 - protein, 2162 aa, Homo sapiens
  Payload ID: 2293
  Gene Symbol: CAD
  Gene Name: carbamoyl-phosphate synthetase 2, aspartate transcarbamylase, and dihydroorotase
  ENSP ID: ENSP00000384510
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 11651 - protein, 279 aa, Homo sapiens
  Payload ID: 2293
  Gene Symbol: CAD
  Gene Name: carbamoyl-phosphate synthetase 2, aspartate transcarbamylase, and dihydroorotase
  ENSP ID: ENSP00000388740
  MOD_RES (1)..(1): Any amino acid
XLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAVFLRPGAGIPRGSRAWAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVST

SEQ ID NO: 11652 - protein, 293 aa, Homo sapiens
  Payload ID: 2293
  Gene Symbol: CAD
  Gene Name: carbamoyl-phosphate synthetase 2, aspartate transcarbamylase, and dihydroorotase
  ENSP ID: ENSP00000405416
  MOD_RES (1)..(1): Any amino acid
XASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQVRPSQPCLEAMEMWVGQSEPSAASTMALLTLQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 11653 - protein, 269 aa, Homo sapiens
  Payload ID: 2293
  Gene Symbol: CAD
  Gene Name: carbamoyl-phosphate synthetase 2, aspartate transcarbamylase, and dihydroorotase
  ENSP ID: ENSP00000414742
  MOD_RES (1)..(1): Any amino acid
XVKVTAVDWHFEEAVDGECPPQRSILEQLAEKNFELVINLSMRGAGGRRLSSFVTKGYRTRRLAADFSVPLIIDIKCTKLFVELTAFHLQALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVAR

SEQ ID NO: 11654 - protein, 352 aa, Homo sapiens
  Payload ID: 2294
  Gene Symbol: CHST11
  Gene Name: carbohydrate (chondroitin 4) sulfotransferase 11
  Uniprot ID: Q9NPF2
  ENSP ID: ENSP00000305725
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 11655 - protein, 72 aa, Homo sapiens
  Payload ID: 2294
  Gene Symbol: CHST11
  Gene Name: carbohydrate (chondroitin 4) sulfotransferase 11
  ENSP ID: ENSP00000448678
MKPALLEVMRMNRICRMVLATCLGSFILVIFYFQIMRRNPFGVDICCRKGSRSPLQELYNPIQVSFKHSVSM

SEQ ID NO: 11656 - protein, 77 aa, Homo sapiens
  Payload ID: 2294
  Gene Symbol: CHST11
  Gene Name: carbohydrate (chondroitin 4) sulfotransferase 11
  ENSP ID: ENSP00000449093
MKPALLEVMRMNRICRMVLATCLGSFILVIFYFQSMLHPVMRRNPFGVDICCRKGSRSPLQELYNPIQVSFKHSVSM

SEQ ID NO: 11657 - protein, 158 aa, Homo sapiens
  Payload ID: 2294
  Gene Symbol: CHST11
  Gene Name: carbohydrate (chondroitin 4) sulfotransferase 11
  ENSP ID: ENSP00000449095
MRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRN

SEQ ID NO: 11658 - protein, 347 aa, Homo sapiens
  Payload ID: 2294
  Gene Symbol: CHST11
  Gene Name: carbohydrate (chondroitin 4) sulfotransferase 11
  Uniprot ID: Q9NPF2
  ENSP ID: ENSP00000450004
MKPALLEVMRMNRICRMVLATCLGSFILVIFYFQIMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 11659 - protein, 414 aa, Homo sapiens
  Payload ID: 2295
  Gene Symbol: CHST12
  Gene Name: carbohydrate (chondroitin 4) sulfotransferase 12
  Uniprot ID: Q9NRB3
  ENSP ID: ENSP00000258711
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 11660 - protein, 245 aa, Homo sapiens
  Payload ID: 2295
  Gene Symbol: CHST12
  Gene Name: carbohydrate (chondroitin 4) sulfotransferase 12
  ENSP ID: ENSP00000411207
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVR

SEQ ID NO: 11661 - protein, 414 aa, Homo sapiens; identical to SEQ ID NO: 11659
  Payload ID: 2295
  Gene Symbol: CHST12
  Gene Name: carbohydrate (chondroitin 4) sulfotransferase 12
  Uniprot ID: Q9NRB3
  ENSP ID: ENSP00000481912

SEQ ID NO: 11662 - protein, 341 aa, Homo sapiens
  Payload ID: 2296
  Gene Symbol: CHST13
  Gene Name: carbohydrate (chondroitin 4) sulfotransferase 13
  Uniprot ID: Q8NET6
  ENSP ID: ENSP00000317404
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARPYSAAFQRRYGARIVQRLRPRALPDARARGHDVRFAEFLAYLLDPRTRREEPFNEHWERAHALCHPCRLRYDVVGKFETLAEDAAFVLGLAGASDLSFPGPPRPRGAAASRDLAARLFRDISPFYQRRLFDLYKMDFLLFNYSAPSYLRLL

SEQ ID NO: 11663 - protein, 225 aa, Homo sapiens [sequence omitted]

SEQ ID NO: 11664 - protein, 479 aa, Homo sapiens
  Payload ID: 2297
  Gene Symbol: CHST3
  Gene Name: carbohydrate (chondroitin 6) sulfotransferase 3
  Uniprot ID: Q7LGC8
  ENSP ID: ENSP00000362207
MEKGLTLPQDCRDFVHSLKMRSKYALFLVFVVIVFVFIEKENKIISRVSDKLKQIPQALADANSTDPALILAENASLLSLSELDSAFSQLQSRLRNLSLQLGVEPAMEAAGEEEEEQRKEEEPPRPAVAGPRRHVLLMATTRTGSSFVGEFFNQQGNIFYLFEPLWHIERTVSFEPGGANAAGSALVYRDVLKQLFLCDLYVLEHFITPLPEDHLTQFMFRRGSSRSLCEDPVCTPFVKKVFEKYHCKNRRCGPLNVTLAAEACRRKEHMALKAVRIRQLEFLQPLAEDPRLDLRVIQLVRDPRAVLASRMVAFAGKYKTWKKWLDDEGQDGLREEEVQRLRGNCESIRLSAELGLRQPAWLRGRYMLVRYEDVARGPLQKAREMYRFAGIPLTPQVEDWIQKNTQAAHDGSGIYSTQKNSSEQFEKWRFSMPFKLAQVVQAACGPAMRLFGYKLARDAAALTNRSVSLLEERGTFWVT

SEQ ID NO: 11665 - protein, 411 aa, Homo sapiens
  Payload ID: 2298
  Gene Symbol: CHST1
  Gene Name: carbohydrate (keratan sulfate Gal-6) sulfotransferase 1
  Uniprot ID: O43916
  ENSP ID: ENSP00000309270
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 11666 - protein, 376 aa, Homo sapiens
  Payload ID: 2299
  Gene Symbol: CHST14
  Gene Name: carbohydrate (N-acetylgalactosamine 4-0) sulfotransferase 14
  Uniprot ID: Q8NCH0
  ENSP ID: ENSP00000307297
MFPRPLTPLAAPNGAEPLGRALRRAPLGRARAGLGGPPLLLPSMLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRHILVSDRYRFLYCYVPKVACSNWKRVMKVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 11667 - protein, 351 aa, Homo sapiens
  Payload ID: 2299
  Gene Symbol: CHST14
  Gene Name: carbohydrate (N-acetylgalactosamine 4-0) sulfotransferase 14
  ENSP ID: ENSP00000453882
MFPRPLTPLAAPNGAEPLGRALRRAPLGRARAGLGGPPLLLPSMLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRHILVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 11668 - protein, 424 aa, Homo sapiens
  Payload ID: 2300
  Gene Symbol: CHST8
  Gene Name: carbohydrate (N-acetylgalactosamine 4-0) sulfotransferase 8
  Uniprot ID: Q9H2A9
  ENSP ID: ENSP00000262622
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTPRHVSRIFVEDRHRVLYCEVPKAGCSNWKRVLMVLAGLASSTADIQHNTVHYGSALKRLDTFDRQGILHRLSTYTKMLFVREPFERLVSAFRDKFEHPNSYYHPVFGKAILARYRANASREALRTGSGVRFPEFVQYLLDVHRPVGMDIHWDHVSRLCSPCLIDYDFVGKFESMEDDANFFLSLIRAPRNLTFPRFKDRHSQEARTTARIAHQYFAQLSALQRQRTYDFYYMDYLMFNYSKPFADLY

SEQ ID NO: 11669 - protein, 424 aa, Homo sapiens; identical to SEQ ID NO: 11668
  Payload ID: 2300
  Gene Symbol: CHST8
  Gene Name: carbohydrate (N-acetylgalactosamine 4-0) sulfotransferase 8
  Uniprot ID: Q9H2A9
  ENSP ID: ENSP00000392604

SEQ ID NO: 11670 - protein, 424 aa, Homo sapiens; identical to SEQ ID NO: 11668
  Payload ID: 2300
  Gene Symbol: CHST8
  Gene Name: carbohydrate (N-acetylgalactosamine 4-0) sulfotransferase 8
  Uniprot ID: Q9H2A9
  ENSP ID: ENSP00000393879

SEQ ID NO: 11671 - protein, 178 aa, Homo sapiens
  Payload ID: 2300
  Gene Symbol: CHST8
  Gene Name: carbohydrate (N-acetylgalactosamine 4-0) sulfotransferase 8
  ENSP ID: ENSP00000467012
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTP

SEQ ID NO: 11672 - protein, 358 aa, Homo sapiens
  Payload ID: 2301
  Gene Symbol: CHST9
  Gene Name: carbohydrate (N-acetylgalactosamine 4-0) sulfotransferase 9
  ENSP ID: ENSP00000284224
MPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 11673 - protein, 443 aa, Homo sapiens
  Payload ID: 2301
  Gene Symbol: CHST9
  Gene Name: carbohydrate (N-acetylgalactosamine 4-0) sulfotransferase 9
  Uniprot ID: Q7L1S5
  ENSP ID: ENSP00000462852
MQPSEMVMNPKQVFLSVLIFGVAGLLLFMYLQVWIEEQHTGRVEKRREQKVTSGWGPVKYLRPVPRIMSTEKIQEHITNQNPKFHMPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 11674 - protein, 74 aa, Homo sapiens
  Payload ID: 2301
  Gene Symbol: CHST9
  Gene Name: carbohydrate (N-acetylgalactosamine 4-0) sulfotransferase 9
  Uniprot ID: Q7L1S5
  ENSP ID: ENSP00000464655
MQPSEMVMNPKQVFLSVLIFGVAGLLLFMYLQVWIEEQHTGRVEKRREQKVTSGWGPVKYLRPVPRIKPQVSHA

SEQ ID NO: 11675 - protein, 443 aa, Homo sapiens; identical to SEQ ID NO: 11673
  Payload ID: 2301
  Gene Symbol: CHST9
  Gene Name: carbohydrate (N-acetylgalactosamine 4-0) sulfotransferase 9
  Uniprot ID: Q7L1S5
  ENSP ID: ENSP00000480991

SEQ ID NO: 11676 - protein, 561 aa, Homo sapiens
  Payload ID: 2302
  Gene Symbol: CHST15
  Gene Name: carbohydrate (N-acetylgalactosamine 4-sulfate 6-O) sulfotransferase 15
  Uniprot ID: Q7LFX5
  ENSP ID: ENSP00000333947
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 11677 - protein, 561 aa, Homo sapiens; identical to SEQ ID NO: 11676
  Payload ID: 2302
  Gene Symbol: CHST15
  Gene Name: carbohydrate (N-acetylgalactosamine 4-sulfate 6-O) sulfotransferase 15
  Uniprot ID: Q7LFX5
  ENSP ID: ENSP00000402394

SEQ ID NO: 11678 - protein, 506 aa, Homo sapiens
  Payload ID: 2302
  Gene Symbol: CHST15
  Gene Name: carbohydrate (N-acetylgalactosamine 4-sulfate 6-O) sulfotransferase 15
  Uniprot ID: Q7LFX5
  ENSP ID: ENSP00000485905
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVCTPPPRTPRAGPWQKELVCCYYASGIVGLRFSIGTERSVLMCKCCSPLFMDVKAEN

SEQ ID NO: 11679 - protein, 66 aa, Homo sapiens
  Payload ID: 2302
  Gene Symbol: CHST15
  Gene Name: carbohydrate (N-acetylgalactosamine 4-sulfate 6-O) sulfotransferase 15
  ENSP ID: ENSP00000487014
MRHCINCCIQLLPDGAHKQQVNCQGGPHHGHQACPTCKGENKILFRVDSKQMNLLAVLEVRTEGNE

SEQ ID NO: 11680 - protein, 386 aa, Homo sapiens
  Payload ID: 2303
  Gene Symbol: CHST4
  Gene Name: carbohydrate (N-acetylglucosamine 6-O) sulfotransferase 4
  Uniprot ID: Q8NCG5
  ENSP ID: ENSP00000341206
MLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLEIYKTIQSLPKALQERYLLVRYEDLARAPVAQTSRMYEFVGLEFLPHLQTWVHNITRGKGMGDHAFHTNARDALNVSQAWRWSLPYEKVSRLQKACGDAMNLLGYRHVRSEQEQRNLLLDLLSTWTVPEQIH

SEQ ID NO: 11681 - protein, 386 aa, Homo sapiens; identical to SEQ ID NO: 11680
  Payload ID: 2303
  Gene Symbol: CHST4
  Gene Name: carbohydrate (N-acetylglucosamine 6-O) sulfotransferase 4
  Uniprot ID: Q8NCG5
  ENSP ID: ENSP00000441204

SEQ ID NO: 11682 - protein, 411 aa, Homo sapiens
  Payload ID: 2304
  Gene Symbol: CHST5
  Gene Name: carbohydrate (N-acetylglucosamine 6-O) sulfotransferase 5
  Uniprot ID: Q9GZS9
  ENSP ID: ENSP00000338783
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 11683 - protein, 99 aa, Homo sapiens
  Payload ID: 2304
  Gene Symbol: CHST5
  Gene Name: carbohydrate (N-acetylglucosamine 6-O) sulfotransferase 5
  ENSP ID: ENSP00000454375
MSRHLPWICDQRCSSPSSPGRWPPAARMWLPRFSSKTVTVLLLAQTTCLLLFIISRPGPSSPAGGEDRVHVLVLSSWRSGSSFLGQLFSQHPDVFYLME

SEQ ID NO: 11684 - protein, 395 aa, Homo sapiens
  Payload ID: 2305
  Gene Symbol: CHST6
  Gene Name: carbohydrate (N-acetylglucosamine 6-O) sulfotransferase 6
  Uniprot ID: Q9GZX3
  ENSP ID: ENSP00000328983
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 11685 - protein, 395 aa, Homo sapiens; identical to SEQ ID NO: 11684
  Payload ID: 2305
  Gene Symbol: CHST6
  Gene Name: carbohydrate (N-acetylglucosamine 6-O) sulfotransferase 6
  Uniprot ID: Q9GZX3
  ENSP ID: ENSP00000375079

SEQ ID NO: 11686 - protein, 486 aa, Homo sapiens
  Payload ID: 2306
  Gene Symbol: CHST7
  Gene Name: carbohydrate (N-acetylglucosamine 6-O) sulfotransferase 7
  Uniprot ID: Q9NS84
  ENSP ID: ENSP00000276055
MKGRRRRRREYCKFALLLVLYTLVLLLVPSVLDGGRDGDKGAEHCPGLQRSLGVWSLEAAAAGEREQGAEARAAEEGGANQSPRFPSNLSGAVGEAVSREKQHIYVHATWRTGSSFLGELFNQHPDVFYLYEPMWHLWQALYPGDAESLQGALRDMLRSLFRCDFSVLRLYAPPGDPAARAPDTANLTTAALFRWRTNKVICSPPLCPGAPRARAEVGLVEDTACERSCPPVAIRALEAECRKYPVVVIKDVRLLDLGVLVPLLRDPGLNLKVVQLFRDPRAVHNSRLKSRQGLLRESIQVLRTRQRGDRFHRVLLAHGVGARPGGQSRALPAAPRADFFLTGALEVICEAWLRDLLFARGAPAWLRRRYLRLRYEDLVRQPRAQLRRLLRFSGLRALAALDAFALNMTRGAAYGADRPFHLSARDAREAVHAWRERLSREQVRQVEAACAPAMRLLAYPRSGEEGDAEQPREGETPLEMDADGAT

SEQ ID NO: 11687 - protein, 530 aa, Homo sapiens
  Payload ID: 2307
  Gene Symbol: CHST2
  Gene Name: carbohydrate (N-acetylglucosamine-6-O) sulfotransferase 2
  Uniprot ID: Q9Y4C5
  ENSP ID: ENSP00000307911
MSRSPQRALPPGALPRLLQAAPAAAPRALLPQWPRRPGRRWPASPLGMKVFRRKALVLCAGYALLLVLTMLNLLDYKWHKEPLQQCNPDGPLGAAAGAAGGSWGRPGPPPAGPPRAHARLDLRTPYRPPAAAVGAAPAAAAGMAGVAAPPGNGTRGTGGVGDKRQLVYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTLVIKGVRVFDVAVLAPLLRDPALDLKVIHLVRDPRAVASSRIRSRHGLIRESLQVVRSRDPRAHRMPFLEAAGHKLGAKKEGVGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 11688 - protein, 390 aa, Homo sapiens
  Payload ID: 2308
  Gene Symbol: CARKD
  Gene Name: carbohydrate kinase domain containing
  Uniprot ID: Q8IW45
  ENSP ID: ENSP00000311984
MVTRAGAGTAVAGAVVVALLSAALALYGPPLDAVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGGISDLKLTIWGPEIETGVKTRAQGSCGPRTTTPTSPHLLLSPSPQVQPSPGGRVWRLLSHQAVQPPSLPEARSLHHHLRHDRRGGGRLQQAL

SEQ ID NO: 11689 - protein, 237 aa, Homo sapiens
  Payload ID: 2308
  Gene Symbol: CARKD
  Gene Name: carbohydrate kinase domain containing
  Uniprot ID: Q8IW45
  ENSP ID: ENSP00000413191
MLPDGPGSSLWGNPGLQTSDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 11690 - protein, 356 aa, Homo sapiens
  Payload ID: 2309
  Gene Symbol: CHST10
  Gene Name: carbohydrate sulfotransferase 10
  Uniprot ID: O43529
  ENSP ID: ENSP00000264249
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 11691 - protein, 141 aa, Homo sapiens
  Payload ID: 2309
  Gene Symbol: CHST10
  Gene Name: carbohydrate sulfotransferase 10
  ENSP ID: ENSP00000387121
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVL

SEQ ID NO: 11692 - protein, 356 aa, Homo sapiens; identical to SEQ ID NO: 11690
  Payload ID: 2309
  Gene Symbol: CHST10
  Gene Name: carbohydrate sulfotransferase 10
  Uniprot ID: O43529
  ENSP ID: ENSP00000387309

SEQ ID NO: 11693 - protein, 142 aa, Homo sapiens
  Payload ID: 2309
  Gene Symbol: CHST10
  Gene Name: carbohydrate sulfotransferase 10
  ENSP ID: ENSP00000387977
MQRKAGKKEHVQLRDKRNQEPQFRGNTARKCEPQAAEGRVSEWLRCDNMHHQWLLLAACFWVIFMFMVASKFITLTFKDPDVYSAKQEFLFLTTMPEVRKLPEEKHIPEELKPTGKELPDSQLVQPLVYMERLELIRNVCRD

SEQ ID NO: 11694 - protein, 33 aa, Homo sapiens
  Payload ID: 2309
  Gene Symbol: CHST10
  Gene Name: carbohydrate sulfotransferase 10
  ENSP ID: ENSP00000395643
MHHQWLLLAACFWVIFMFMVASKFITLTFKDPD

SEQ ID NO: 11695 - protein, 133 aa, Homo sapiens
  Payload ID: 2309
  Gene Symbol: CHST10
  Gene Name: carbohydrate sulfotransferase 10
  ENSP ID: ENSP00000405922
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQ

SEQ ID NO: 11696 - protein, 85 aa, Homo sapiens
  Payload ID: 2309
  Gene Symbol: CHST10
  Gene Name: carbohydrate sulfotransferase 10
  ENSP ID: ENSP00000407525
MHHQWLLLAACFWVIFMFMVASKFITLTFKDPDVYSAKQEFLFLTTMPEVRKLPEEKHIPEELKPTGKELPDSQLVQPLVYMERL

SEQ ID NO: 11697 - protein, 64 aa, Homo sapiens
  Payload ID: 2309
  Gene Symbol: CHST10
  Gene Name: carbohydrate sulfotransferase 10
  ENSP ID: ENSP00000416831
MHHQWLLLAACFWVIFMFMVASKFITLTFKDPDVYSAKQEFLFLTTMPEVRKLPEEKHIPEELK

SEQ ID NO: 11698 - protein, 261 aa, Homo sapiens
  Payload ID: 2310
  Gene Symbol: CA1
  Gene Name: carbonic anhydrase I
  Uniprot ID: P00915
  ENSP ID: ENSP00000392338
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 11699 - protein, 127 aa, Homo sapiens
  Payload ID: 2310
  Gene Symbol: CA1
  Gene Name: carbonic anhydrase I
  ENSP ID: ENSP00000427773
MMTKMLHVAHWNSAKYSSLAEAASKADGLAVIGVLMKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 11700 - protein, 149 aa, Homo sapiens
  Payload ID: 2310
  Gene Symbol: CA1
  Gene Name: carbonic anhydrase I
  ENSP ID: ENSP00000427852
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLM

SEQ ID NO: 11701 - protein, 194 aa, Homo sapiens
  Payload ID: 2310
  Gene Symbol: CA1
  Gene Name: carbonic anhydrase I
  ENSP ID: ENSP00000428923
MASPDWGYDDKNVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRAS

SEQ ID NO: 11702 - protein, 178 aa, Homo sapiens
  Payload ID: 2310
  Gene Symbol: CA1
  Gene Name: carbonic anhydrase I
  ENSP ID: ENSP00000429300
  MOD_RES (1)..(1): Any amino acid
XHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQHNNRPTQPLKGRTVRASF

SEQ ID NO: 11703 - protein, 22 aa, Homo sapiens
  Payload ID: 2310
  Gene Symbol: CA1
  Gene Name: carbonic anhydrase I
  ENSP ID: ENSP00000429688
MASPDWGYDDKNGPEQWSKLYP

SEQ ID NO: 11704 - protein, 261 aa, Homo sapiens; identical to SEQ ID NO: 11698
  Payload ID: 2310
  Gene Symbol: CA1
  Gene Name: carbonic anhydrase I
  Uniprot ID: P00915
  ENSP ID: ENSP00000429798

SEQ ID NO: 11705 - protein, 175 aa, Homo sapiens
  Payload ID: 2310
  Gene Symbol: CA1
  Gene Name: carbonic anhydrase I
  ENSP ID: ENSP00000429843
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRA

SEQ ID NO: 11706 - protein, 118 aa, Homo sapiens
  Payload ID: 2310
  Gene Symbol: CA1
  Gene Name: carbonic anhydrase I
  ENSP ID: ENSP00000430372
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAE

SEQ ID NO: 11707 - protein, 149 aa, Homo sapiens; identical to SEQ ID NO: 11700
  Payload ID: 2310
  Gene Symbol: CA1
  Gene Name: carbonic anhydrase I
  ENSP ID: ENSP00000430471

SEQ ID NO: 11708 - protein, 137 aa, Homo sapiens
  Payload ID: 2310
  Gene Symbol: CA1
  Gene Name: carbonic anhydrase I
  ENSP ID: ENSP00000430543
MMTKMLHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQ

SEQ ID NO: 11709 - protein, 87 aa, Homo sapiens
  Payload ID: 2310
  Gene Symbol: CA1
  Gene Name: carbonic anhydrase I
  ENSP ID: ENSP00000430571
MMTKMLHVAHWNSAKYSSLAEAASKADGLAVIGVLMKVGEANPKLQKVLDALQAIKTKGKRAPFTNFDPSTLLPSSLDFWTYPGSLT

SEQ ID NO: 11710 - protein, 261 aa, Homo sapiens; identical to SEQ ID NO: 11698
  Payload ID: 2310
  Gene Symbol: CA1
  Gene Name: carbonic anhydrase I
  Uniprot ID: P00915
  ENSP ID: ENSP00000430656

SEQ ID NO: 11711 - protein, 81 aa, Homo sapiens
  Payload ID: 2310
  Gene Symbol: CA1
  Gene Name: carbonic anhydrase I
  ENSP ID: ENSP00000430710
MASPDWGYDDKNGPEQWSKLYPIANGNNQSPVDIKTSETKHDTSLKPISVSYNPATAKEIINVGHSFHVNFEDNDNRSALL

SEQ ID NO: 11712 - protein, 148 aa, Homo sapiens
  Payload ID: 2310
  Gene Symbol: CA1
  Gene Name: carbonic anhydrase I
  ENSP ID: ENSP00000430737
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVL

SEQ ID NO: 11713 - protein, 251 aa, Homo sapiens
  Payload ID: 2310
  Gene Symbol: CA1
  Gene Name: carbonic anhydrase I
  ENSP ID: ENSP00000430861
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQP

SEQ ID NO: 11714 - protein, 99 aa, Homo sapiens
  Payload ID: 2310
  Gene Symbol: CA1
  Gene Name: carbonic anhydrase I
  ENSP ID: ENSP00000430975
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWG

SEQ ID NO: 11715 - protein, 261 aa, Homo sapiens; identical to SEQ ID NO: 11698
  Payload ID: 2310
  Gene Symbol: CA1
  Gene Name: carbonic anhydrase I
  Uniprot ID: P00915
  ENSP ID: ENSP00000443517

SEQ ID NO: 11716 - protein, 127 aa, Homo sapiens; identical to SEQ ID NO: 11699
  Payload ID: 2310
  Gene Symbol: CA1
  Gene Name: carbonic anhydrase I
  ENSP ID: ENSP00000486171

SEQ ID NO: 11717 - protein, 260 aa, Homo sapiens
  Payload ID: 2311
  Gene Symbol: CA2
  Gene Name: carbonic anhydrase II
  Uniprot ID: P00918
  ENSP ID: ENSP00000285379
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 11718 - protein, 97 aa, Homo sapiens
  Payload ID: 2311
  Gene Symbol: CA2
  Gene Name: carbonic anhydrase II
  ENSP ID: ENSP00000428443
MSHHWGYGKHNGPEHWHKDFPIAKGERQSPVDIDTHTAKYDPSLKPLSVSYDQATSLRILNNGHAFNVEFDDSQDKAASLGSLEHQIWGFWESCAAT

SEQ ID NO: 11719 - protein, 101 aa, Homo sapiens
  Payload ID: 2311
  Gene Symbol: CA2
  Gene Name: carbonic anhydrase II
  ENSP ID: ENSP00000428947
MSHHWGYGKHNGPEHWHKDFPIAKGERQSPVDIDTHTAKYDPSLKPLSVSYDQATSLRILNNGHAFNVEFDDSQDKAEKGISMLRKKDVKNIHSPDNACEE

SEQ ID NO: 11720 - protein, 260 aa, Homo sapiens
  Payload ID: 2312
  Gene Symbol: CA3
  Gene Name: carbonic anhydrase III
  Uniprot ID: P07451
  ENSP ID: ENSP00000285381
MAKEWGYASHNGPDHWHELFPNAKGENQSPVELHTKDIRHDPSLQPWSVSYDGGSAKTILNNGKTCRVVFDDTYDRSMLRGGPLPGPYRLRQFHLHWGSSDDHGSEHTVDGVKYAAELHLVHWNPKYNTFKEALKQRDGIAVIGIFLKIGHENGEFQIFLDALDKIKTKGKEAPFTKFDPSCLFPACRDYWTYQGSFTTPPCEECIVWLLLKEPMTVSSDQMAKLRSLLSSAENEPPVPLVSNWRPPQPINNRVVRASFK

SEQ ID NO: 11721 - protein, 19 aa, Homo sapiens
  Payload ID: 2312
  Gene Symbol: CA3
  Gene Name: carbonic anhydrase III
  ENSP ID: ENSP00000429760
MLRGGPLPGPYRLRQFHLH

SEQ ID NO: 11722 - protein, 312 aa, Homo sapiens
  Payload ID: 2313
  Gene Symbol: CA4
  Gene Name: carbonic anhydrase IV
  Uniprot ID: P22748
  ENSP ID: ENSP00000300900
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 11723 - protein, 99 aa, Homo sapiens
  Payload ID: 2313
  Gene Symbol: CA4
  Gene Name: carbonic anhydrase IV
  ENSP ID: ENSP00000464757
  MOD_RES (1)..(1): Any amino acid
XSNIPKPEMSTTMAESSLLDLLPKEEKLRHYFRYLGSLTTPTCDEKVVWTVFREPIQLHREQVHRAWGRAWAPTAWLPRNYPSVCPQRSLRIQVGSPGN

SEQ ID NO: 11724 - protein, 184 aa, Homo sapiens
  Payload ID: 2313
  Gene Symbol: CA4
  Gene Name: carbonic anhydrase IV
  ENSP ID: ENSP00000465837
VKEAQDPEDEIAVLAFLVEIGRMNWPPPLAPCRLSQDPSLPFQAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 11725 - protein, 38 aa, Homo sapiens
  Payload ID: 2313
  Gene Symbol: CA4
  Gene Name: carbonic anhydrase IV
  ENSP ID: ENSP00000466964
MMLLENKASISGGGLPAPYQAKQLHLHWSDLPYKGSEH

SEQ ID NO: 11726 - protein, 106 aa, Homo sapiens
  Payload ID: 2313
  Gene Symbol: CA4
  Gene Name: carbonic anhydrase IV
  Uniprot ID: P22748
  ENSP ID: ENSP00000467465
MRMLLALLALSAARPSASAESHWCYEVQAESSNYPCLVPVKWGGNCQKDRQSPINIVTTKAKVDKKLGRFFFSGYDKKQTWTVQNNGHSGWNPGERGLPATGGGTV

SEQ ID NO: 11727 - protein, 459 aa, Homo sapiens
  Payload ID: 2314
  Gene Symbol: CA9
  Gene Name: carbonic anhydrase IX
  Uniprot ID: Q16790
  ENSP ID: ENSP00000367608
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 11728 - protein, 356 aa, Homo sapiens [sequence omitted]

SEQ ID NO: 11729 - protein, 305 aa, Homo sapiens
  Payload ID: 2315
  Gene Symbol: CA5A
  Gene Name: carbonic anhydrase VA, mitochondrial
  Uniprot ID: P35218
  ENSP ID: ENSP00000309649
MLGRNTWKTSAFSFLVEQMWAPLWSRSMRPGRWCSQRSCAWQTSNNTLHPLWTVPVSVPGGTRQSPINIQWRDSVYDPQLKPLRVSYEAASCLYIWNTGYLFQVEFDDATEASGISGGPLENHYRLKQFHFHWGAVNEGGSEHTVDGHAYPAELHLVHWNSVKYQNYKEAVVGENGLAVIGVFLKLGAHHQTLQRLVDILPEIKHKDARAAMRPFDPSTLLPTCWDYWTYAGSLTTPPLTESVTWIIQKEPVEVAPSQLSAFRTLLFSALGEEEKMMVNNYRPLQPLMNRKVWASFQATNEGTRS

SEQ ID NO: 11730 - protein, 317 aa, Homo sapiens
  Payload ID: 2316
  Gene Symbol: CA5B
  Gene Name: carbonic anhydrase VB, mitochondrial
  Uniprot ID: Q9Y2D0
  ENSP ID: ENSP00000314099
MVVMNSLRVILQASPGKLLWRKFQIPRFMPARPCSLYTCTYKTRNRALHPLWESVDLVPGGDRQSPINIRWRDSVYDPGLKPLTISYDPATCLHVWNNGYSFLVEFEDSTDKSVIKGGPLEHNYRLKQFHFHWGAIDAWGSEHTVDSKCFPAELHLVHWNAVRFENFEDAALEENGLAVIGVFLKLGKHHKELQKLVDTLPSIKHKDALVEFGSFDPSCLMPTCPDYWTYSGSLTTPPLSESVTWIIKKQPVEVDHDQLEQFRTLLFTSEGEKEKRMVDNFRPLQPLMNRTVRSSFRHDYVLNVQAKPKPATSQATP

SEQ ID NO: 11731 - protein, 317 aa, Homo sapiens; identical to SEQ ID NO: 11730
  Payload ID: 2316
  Gene Symbol: CA5B
  Gene Name: carbonic anhydrase VB, mitochondrial
  Uniprot ID: Q9Y2D0
  ENSP ID: ENSP00000417021

SEQ ID NO: 11732 - protein, 70 aa, Homo sapiens
  Payload ID: 2316
  Gene Symbol: CA5B
  Gene Name: carbonic anhydrase VB, mitochondrial
  ENSP ID: ENSP00000417236
  MOD_RES (1)..(1): Any amino acid
XVDLVPGGDRQSPINIRWRDSVYDPGLKPLTISYDPATCLHVWNNGYSFLVEFEDSTDKSECAPFSTGSP

SEQ ID NO: 11733 - protein, 136 aa, Homo sapiens
  Payload ID: 2316
  Gene Symbol: CA5B
  Gene Name: carbonic anhydrase VB, mitochondrial
  ENSP ID: ENSP00000417553
MVVMNSLRVILQASPGKLLWRKFQIPRFMPARPCSLYTCTYKTRNRALHPLWESVDLVPGGDRQSPINIRWRDSVYDPGLKPLTISYDPATCLHVWNNGYSFLVEFEDSTDKSVIKGGPLEHNYRLKQFHFHWGAI

SEQ ID NO: 11734 - protein, 76 aa, Homo sapiens
  Payload ID: 2316
  Gene Symbol: CA5B
  Gene Name: carbonic anhydrase VB, mitochondrial
  ENSP ID: ENSP00000418622
MVVMNSLRVILQASPGKLLWRKFQIPRFMPARPCSLYTCTYKTRNRALHPLWESVDLVPGGDRQSPINIRWRDSVY

SEQ ID NO: 11735 - protein, 313 aa, Homo sapiens
  Payload ID: 2317
  Gene Symbol: CA6
  Gene Name: carbonic anhydrase VI
  Uniprot ID: P23280
  ENSP ID: ENSP00000366654
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQGKGHGGHRGRSQNPRVQPTSTRHPLALGSLEA

SEQ ID NO: 11736 - protein, 248 aa, Homo sapiens
  Payload ID: 2317
  Gene Symbol: CA6
  Gene Name: carbonic anhydrase VI
  Uniprot ID: P23280
  ENSP ID: ENSP00000366661
MRALVLLLSLFLLGGQAQHVSDWTYSVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQEYTLGSEFQFYLHKIEEILDYLRRALN

SEQ ID NO: 11737 - protein, 308 aa, Homo sapiens
  Payload ID: 2317
  Gene Symbol: CA6
  Gene Name: carbonic anhydrase VI
  Uniprot ID: P23280
  ENSP ID: ENSP00000366662
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQEYTLGSEFQFYLHKIEEILDYLRRALN

SEQ ID NO: 11738 - protein, 179 aa, Homo sapiens
  Payload ID: 2317
  Gene Symbol: CA6
  Gene Name: carbonic anhydrase VI
  ENSP ID: ENSP00000435280
MRALVLLLSLFLLGGQAQHVSDWTYSEGALDEAHWPQHYPACGGQRQSPINLQRTKVRYNPSLKGLNMTGYETQAGEFPMVNNGHTDWQAELFLPSLSSPCGEGAKHKGQRQWLCSPSLDSWWEAIIDGGSLWATLAECGLRAEGPEEGRHMEEKSPASQGACSGSRLPISRGPCTFFL

SEQ ID NO: 11739 - protein, 187 aa, Homo sapiens
  Payload ID: 2317
  Gene Symbol: CA6
  Gene Name: carbonic anhydrase VI
  ENSP ID: ENSP00000447108
MRALVLLLSLFLLGGQAQHVSDWTYSEGALDEAHWPQHYPACGGQRQSPINLQRTKISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSL

SEQ ID NO: 11740 - protein, 264 aa, Homo sapiens [sequence omitted]

SEQ ID NO: 11741 - protein, 208 aa, Homo sapiens
  Payload ID: 2318
  Gene Symbol: CA7
  Gene Name: carbonic anhydrase VII
  Uniprot ID: P43166
  ENSP ID: ENSP00000377632
MSLSITNNGHSVQVDFNDSDDRTVVTGGPLEGPYRLKQFHFHWGKKHDVGSEHTVDGKSFPSELHLVHWNAKKYSTFGEAASAPDGLAVVGVFLETGDEHPSMNRLTDALYMVRFKGTKAQFSCFNPKCLLPASRHYWTYPGSLTTPPLSESVTWIVLREPICISERQMGKFRSLLFTSEDDERIHMVNNFRPPQPLKGRVVKASFRA

SEQ ID NO: 11742 - protein, 44 aa, Homo sapiens
  Payload ID: 2318
  Gene Symbol: CA7
  Gene Name: carbonic anhydrase VII
  ENSP ID: ENSP00000447178
MSLSITNNGHSVQVDFNDSDDRTAASGSLECQEVQHFWGGGLST

SEQ ID NO: 11743 - protein, 290 aa, Homo sapiens
  Payload ID: 2319
  Gene Symbol: CA8
  Gene Name: carbonic anhydrase VIII
  Uniprot ID: P35219
  ENSP ID: ENSP00000314407
MADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 11744 - protein, 328 aa, Homo sapiens
  Payload ID: 2320
  Gene Symbol: CA10
  Gene Name: carbonic anhydrase X
  Uniprot ID: Q9NS85
  ENSP ID: ENSP00000285273
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 11745 - protein, 328 aa, Homo sapiens; identical to SEQ ID NO: 11744
  Payload ID: 2320
  Gene Symbol: CA10
  Gene Name: carbonic anhydrase X
  Uniprot ID: Q9NS85
  ENSP ID: ENSP00000390666

SEQ ID NO: 11746 - protein, 328 aa, Homo sapiens; identical to SEQ ID NO: 11744
  Payload ID: 2320
  Gene Symbol: CA10
  Gene Name: carbonic anhydrase X
  Uniprot ID: Q9NS85
  ENSP ID: ENSP00000405388

SEQ ID NO: 11747 - protein, 56 aa, Homo sapiens
  Payload ID: 2320
  Gene Symbol: CA10
  Gene Name: carbonic anhydrase X
  ENSP ID: ENSP00000458145
HVSLRLDKEHLVNISGGPMTYSHRLEEIRLHFGSEDSQGSEHLLNGQAFSGEEKVC

SEQ ID NO: 11748 - protein, 253 aa, Homo sapiens
  Payload ID: 2320
  Gene Symbol: CA10
  Gene Name: carbonic anhydrase X
  Uniprot ID: Q9NS85
  ENSP ID: ENSP00000459619
MIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 11749 - protein, 276 aa, Homo sapiens
  Payload ID: 2320
  Gene Symbol: CA10
  Gene Name: carbonic anhydrase X
  ENSP ID: ENSP00000460238
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPS

SEQ ID NO: 11750 - protein, 42 aa, Homo sapiens
  Payload ID: 2320
  Gene Symbol: CA10
  Gene Name: carbonic anhydrase X
  ENSP ID: ENSP00000461908
MEIVWEVLFLLQANFIVCISGDLRRAVRRLWWQSGLEMQVTC

SEQ ID NO: 11751 - protein, 328 aa, Homo sapiens
  Payload ID: 2321
  Gene Symbol: CA11
  Gene Name: carbonic anhydrase XI
  Uniprot ID: O75493
  ENSP ID: ENSP00000084798
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 11752 - protein, 113 aa, Homo sapiens
  Payload ID: 2321
  Gene Symbol: CA11
  Gene Name: carbonic anhydrase XI
  ENSP ID: ENSP00000469234
  MOD_RES (1)..(1): Any amino acid
XDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHAQCFST

SEQ ID NO: 11753 - protein, 354 aa, Homo sapiens
  Payload ID: 2322
  Gene Symbol: CA12
  Gene Name: carbonic anhydrase XII
  Uniprot ID: O43570
  ENSP ID: ENSP00000178638
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 11754 - protein, 343 aa, Homo sapiens
  Payload ID: 2322
  Gene Symbol: CA12
  Gene Name: carbonic anhydrase XII
  Uniprot ID: O43570
  ENSP ID: ENSP00000343088
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 11755 - protein, 283 aa, Homo sapiens
  Payload ID: 2322
  Gene Symbol: CA12
  Gene Name: carbonic anhydrase XII
  ENSP ID: ENSP00000403028
MPRRSLHAAAVLLLVILKEQPSSPAPVNGSKWTYFVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 11756 - protein, 262 aa, Homo sapiens
  Payload ID: 2323
  Gene Symbol: CA13
  Gene Name: carbonic anhydrase XIII
  Uniprot ID: Q8N1Q1
  ENSP ID: ENSP00000318912
MSRLSWGYREHNGPIHWKEFFPIADGDQQSPIEIKTKEVKYDSSLRPLSIKYDPSSAKIISNSGHSFNVDFDDTENKSVLRGGPLTGSYRLRQVHLHWGSADDHGSEHIVDGVSYAAELHVVHWNSDKYPSFVEAAHEPDGLAVLGVFLQIGEPNSQLQKITDTLDSIKEKGKQTRFTNFDLLSLLPPSWDYWTYPGSLTVPPLLESVTWIVLKQPINISSQQLAKFRSLLCTAEGEAAAFLVSNHRPPQPLKGRKVRASFH

SEQ ID NO: 11757 - protein, 337 aa, Homo sapiens
  Payload ID: 2324
  Gene Symbol: CA14
  Gene Name: carbonic anhydrase XIV
  Uniprot ID: Q9ULX7
  ENSP ID: ENSP00000358107
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 11758 - protein, 130 aa, Homo sapiens
  Payload ID: 2324
  Gene Symbol: CA14
  Gene Name: carbonic anhydrase XIV
  ENSP ID: ENSP00000475238
QKTSVPPFNLRELLPKQLGQYFRYNGSLTTPPCYQSVLWTVFYRRSQISMEQLEKLQGTLFSTEEEPSKLLVQNYRALQPLNQRMVFASFIQGSSYTTGRRGWKTERVWSSPQHKPRLRHKFLLRYHGCG

SEQ ID NO: 11759 - protein, 42 aa, Homo sapiens
  Payload ID: 2324
  Gene Symbol: CA14
  Gene Name: carbonic anhydrase XIV
  ENSP ID: ENSP00000475869
MLFSALLLEVIWILAADGGQHWTYEAPPFWISSCLEFHIYGS

SEQ ID NO: 11760 - protein, 277 aa, Homo sapiens
  Payload ID: 2325
  Gene Symbol: CBR1
  Gene Name: carbonyl reductase 1
  Uniprot ID: P16152
  ENSP ID: ENSP00000290349
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 11761 - protein, 222 aa, Homo sapiens
  Payload ID: 2325
  Gene Symbol: CBR1
  Gene Name: carbonyl reductase 1
  ENSP ID: ENSP00000382143
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQVVLLLRLWFTRTSKGSSSKSHLTLLSQNSKAGMNFFMQLPPHFLCVFLLELIPVTVSHMKIFCSKIPANLAFTSLRDCCTPFYIMLCGVS

SEQ ID NO: 11762 - protein, 178 aa, Homo sapiens
  Payload ID: 2325
  Gene Symbol: CBR1
  Gene Name: carbonyl reductase 1
  ENSP ID: ENSP00000395132
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGESDGKQRTFSLGLDLAPACLGFLLQAPASSPCCTCTDLCAFSPAS

SEQ ID NO: 11763 - protein, 173 aa, Homo sapiens
  Payload ID: 2325
  Gene Symbol: CBR1
  Gene Name: carbonyl reductase 1
  Uniprot ID: P16152
  ENSP ID: ENSP00000434613
MSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQASCVLSAWSCLSQNPSGGKSKPLAWFTEMSIICRCLTLGPF

SEQ ID NO: 11764 - protein, 277 aa, Homo sapiens
  Payload ID: 2326
  Gene Symbol: CBR3
  Gene Name: carbonyl reductase 3
  Uniprot ID: O75828
  ENSP ID: ENSP00000290354
MSSCSRVALVTGANRGIGLAIARELCRQFSGDVVLTARDVARGQAAVQQLQAEGLSPRFHQLDIDDLQSIRALRDFLRKEYGGLNVLVNNAAVAFKSDDPMPFDIKAEMTLKTNFFATRNMCNELLPIMKPHGRVVNISSLQCLRAFENCSEDLQERFHSETLTEGDLVDLMKKFVEDTKNEVHEREGWPNSPYGVSKLGVTVLSRILARRLDEKRKADRILVNACCPGPVKTDMDGKDSIRTVEEGAETPVYLALLPPDATEPQGQLVHDKVVQNW

SEQ ID NO: 11765 - protein, 237 aa, Homo sapiens
  Payload ID: 2327
  Gene Symbol: CBR4
  Gene Name: carbonyl reductase 4
  Uniprot ID: Q8N4T8
  ENSP ID: ENSP00000303525
MDKVCAVFGGSRGIGRAVAQLMARKGYRLAVIARNLEGAKAAAGDLGGDHLAFSCDVAKEHDVQNTFEELEKHLGRVNFLVNAAGINRDGLLVRTKTEDMVSQLHTNLLGSMLTCKAAMRTMIQQQGGSIVNVGSIVGLKGNSGQSVYSASKGGLVGFSRALAKEVARKKIRVNVVAPGFVHTDMTKDLKEEHLKKNIPLGRFGETIEVAHAVVFLLESPYITGHVLVVDGGLQLIL

SEQ ID NO: 11766 - protein, 60 aa, Homo sapiens
  Payload ID: 2327
  Gene Symbol: CBR4
  Gene Name: carbonyl reductase 4
  ENSP ID: ENSP00000421254
MDKVCAVFGGSRGIGRAVAQLMARKGYRLAVIARNLEGAKAAAGDLGEIFSPQSPKDLGL

SEQ ID NO: 11767 - protein, 186 aa, Homo sapiens
  Payload ID: 2327
  Gene Symbol: CBR4
  Gene Name: carbonyl reductase 4
  ENSP ID: ENSP00000423128
VCAVFGGSRGIGRAVAQLMARKGYRLAVIARNLEGAKAAAGDLGGDHLAFSCDVAKEHDVQNTFEELEKHLGRVNFLVNAAGINRDGLLVRTKTEDMVSQLHTNLLGSMLTCKAAMRTMIQQQGGSIVNVGHRREMLLHKRSIVGLKGNSGQSVYSASKGGLVGFSRALAKEVARKKIRVNVVAPG

SEQ ID NO: 11768 - protein, 51 aa, Homo sapiens
  Payload ID: 2327
  Gene Symbol: CBR4
  Gene Name: carbonyl reductase 4
  ENSP ID: ENSP00000424717
MDKVCAVFGGSRGIGRAVAQLMARKGYRLAVIARNLEGAKAAAGDLGGMVF

SEQ ID NO: 11769 - protein, 60 aa, Homo sapiens
  Payload ID: 2327
  Gene Symbol: CBR4
  Gene Name: carbonyl reductase 4
  ENSP ID: ENSP00000425671
MDKVCAVFGGSRGIGRAVAQLMARKGYRLAVIARNLEGAKAAAGDLGGLPIMLPVLDPNS

SEQ ID NO: 11770 - protein, 179 aa, Homo sapiens
  Payload ID: 2327
  Gene Symbol: CBR4
  Gene Name: carbonyl reductase 4
  Uniprot ID: Q8N4T8
  ENSP ID: ENSP00000427615
MDKVCAVFGGSRGIGRAVAQLMARKGYRLAVIARNLEGAKAAAGDLGGDHLAFSCDVAKEHDVQNTFEELEKHLGRVNFLVNAAGINRDGLLVRTKTEDMVSQLHTNLLGSMLTCKAAMRTMIQQQGGSIVNVGSIVGLKGNSGQSVYSASKGGLVGFSRALAKEVARKKIRVNVVAPG

SEQ ID NO: 11771 - protein, 756 aa, Homo sapiens
  Payload ID: 2328
  Gene Symbol: CEL
  Gene Name: carboxyl ester lipase
  ENSP ID: ENSP00000361151
MLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 11772 - protein, 59 aa, Homo sapiens
  Payload ID: 2328
  Gene Symbol: CEL
  Gene Name: carboxyl ester lipase
  ENSP ID: ENSP00000480238
MLTMGRLQLVVLGLTCCWAVASAAKTPCCTMWASSLSLMETSSPLTRSTCTPTPPTSTI

SEQ ID NO: 11773 - protein, 568 aa, Homo sapiens
  Payload ID: 2329
  Gene Symbol: CES1
  Gene Name: carboxylesterase 1
  Uniprot ID: P23141
  ENSP ID: ENSP00000353720
MWLRAFILATLSASAAWAGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11774 - protein, 567 aa, Homo sapiens
  Payload ID: 2329
  Gene Symbol: CES1
  Gene Name: carboxylesterase 1
  Uniprot ID: P23141
  ENSP ID: ENSP00000355193
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11775 - protein, 566 aa, Homo sapiens
  Payload ID: 2329
  Gene Symbol: CES1
  Gene Name: carboxylesterase 1
  Uniprot ID: P23141
  ENSP ID: ENSP00000390492
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11776 - protein, 44 aa, Homo sapiens
  Payload ID: 2329
  Gene Symbol: CES1
  Gene Name: carboxylesterase 1
  ENSP ID: ENSP00000455902
ERNFHTVPYMVGINKQEFGWLIPMMLEHPPTCMSFSTVQASHQT

SEQ ID NO: 11777 - protein, 131 aa, Homo sapiens
  Payload ID: 2329
  Gene Symbol: CES1
  Gene Name: carboxylesterase 1
  ENSP ID: ENSP00000455959
KELIPEATEKYLGGTDDTVKKKDLFLDLIADVMFGVPSVIVARNHREGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11778 - protein, 44 aa, Homo sapiens; identical to SEQ ID NO: 11776
  Payload ID: 2329
  Gene Symbol: CES1
  Gene Name: carboxylesterase 1
  ENSP ID: ENSP00000456356

SEQ ID NO: 11779 - protein, 84 aa, Homo sapiens
  Payload ID: 2329
  Gene Symbol: CES1
  Gene Name: carboxylesterase 1
  ENSP ID: ENSP00000456865
  MOD_RES (1)..(1): Any amino acid
XRQKTEEELLETTLKMKFLSLDLQGDPRESQPLLGTVIDGMLLLKTPEELQAERNFHTVPYMVGINKQEFGWLIPMGTADISVY

SEQ ID NO: 11780 - protein, 566 aa, Homo sapiens
  Payload ID: 2329
  Gene Symbol: CES1
  Gene Name: carboxylesterase 1
  Uniprot ID: P23141
  ENSP ID: ENSP00000458586
MWLPALVLATLAASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11781 - protein, 134 aa, Homo sapiens
  Payload ID: 2329
  Gene Symbol: CES1
  Gene Name: carboxylesterase 1
  ENSP ID: ENSP00000458773
CIAKELIPEATEKYLGGTDDTVKKKDLFLDLIADVMFGVPSVIVARNHREGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11782 - protein, 84 aa, Homo sapiens; identical to SEQ ID NO: 11779
  Payload ID: 2329
  Gene Symbol: CES1
  Gene Name: carboxylesterase 1
  ENSP ID: ENSP00000459806
  MOD_RES (1)..(1): Any amino acid

SEQ ID NO: 11783 - protein, 567 aa, Homo sapiens
  Payload ID: 2329
  Gene Symbol: CES1
  Gene Name: carboxylesterase 1
  Uniprot ID: P23141
  ENSP ID: ENSP00000460045
MWLPALVLATLAASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11784 - protein, 568 aa, Homo sapiens
  Payload ID: 2329
  Gene Symbol: CES1
  Gene Name: carboxylesterase 1
  Uniprot ID: P23141
  ENSP ID: ENSP00000461208
MWLPALVLATLAASAAWAGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 11785 - protein, 623 aa, Homo sapiens
  Payload ID: 2330
  Gene Symbol: CES2
  Gene Name: carboxylesterase 2
  ENSP ID: ENSP00000317842
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 11786 - protein, 607 aa, Homo sapiens
  Payload ID: 2330
  Gene Symbol: CES2
  Gene Name: carboxylesterase 2
  Uniprot ID: O00748
  ENSP ID: ENSP00000394452
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHVKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 11787 - protein, 122 aa, Homo sapiens
  Payload ID: 2330
  Gene Symbol: CES2
  Gene Name: carboxylesterase 2
  ENSP ID: ENSP00000456167
MTAQSRSPTTPTFPGPSQRTPLTPCPVQTPRLGKALIHCWTDPGQPLGEQQRVRRQRTETSEPTMRLHRLRARLSAVACGLLLLLVRGQGEAPSEGRQGPGSDLPNAAEAEPDSAGGQAPGR

SEQ ID NO: 11788 - protein, 122 aa, Homo sapiens; identical to SEQ ID NO: 11787
  Payload ID: 2330
  Gene Symbol: CES2
  Gene Name: carboxylesterase 2
  ENSP ID: ENSP00000457721

SEQ ID NO: 11789 - protein, 21 aa, Homo sapiens
  Payload ID: 2330
  Gene Symbol: CES2
  Gene Name: carboxylesterase 2
  ENSP ID: ENSP00000463166
MTAQSRSPTTPTFPGPSQRTP

SEQ ID NO: 11790 - protein, 125 aa, Homo sapiens
  Payload ID: 2330
  Gene Symbol: CES2
  Gene Name: carboxylesterase 2
  ENSP ID: ENSP00000463641
MCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGN

SEQ ID NO: 11791 - protein, 201 aa, Homo sapiens
  Payload ID: 2330
  Gene Symbol: CES2
  Gene Name: carboxylesterase 2
  ENSP ID: ENSP00000464620
  MOD_RES (1)..(1): Any amino acid
XVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHVKFTEEEEQLSRKMMKYWANFARNG

SEQ ID NO: 11792 - protein, 571 aa, Homo sapiens
  Payload ID: 2331
  Gene Symbol: CES3
  Gene Name: carboxylesterase 3
  Uniprot ID: Q6UWW8
  ENSP ID: ENSP00000304782
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 11793 - protein, 568 aa, Homo sapiens
  Payload ID: 2331
  Gene Symbol: CES3
  Gene Name: carboxylesterase 3
  ENSP ID: ENSP00000377602
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 11794 - protein, 210 aa, Homo sapiens
  Payload ID: 2331
  Gene Symbol: CES3
  Gene Name: carboxylesterase 3
  Uniprot ID: Q6UWW8
  ENSP ID: ENSP00000445559
MEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 11795 - protein, 40 aa, Homo sapiens
  Payload ID: 2331
  Gene Symbol: CES3
  Gene Name: carboxylesterase 3
  ENSP ID: ENSP00000456203
MERAVRVESGVLVGVVCLLLACPATATGYQDAVWARSCSA

SEQ ID NO: 11796 - protein, 379 aa, Homo sapiens
  Payload ID: 2331
  Gene Symbol: CES3
  Gene Name: carboxylesterase 3
  ENSP ID: ENSP00000457547
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRILEALSFSMSSSIDPVLLRRSNLPG

SEQ ID NO: 11797 - protein, 454 aa, Homo sapiens
  Payload ID: 2332
  Gene Symbol: CES4A
  Gene Name: carboxylesterase 4A
  ENSP ID: ENSP00000441103
GKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYNITKEQVPLVVEEYLDNVNEHDWKMLRNRMMDIVQDATFVYATLQTAHYHRGLSMGKEKALSLQMMKYWANFARTGNPNDGNLPCWPRYNKDEKYLQLDFTTRVGMKLKEKKMAFWMSLYQSQRPEKQRQF

SEQ ID NO: 11798 - protein, 374 aa, Homo sapiens
  Payload ID: 2332
  Gene Symbol: CES4A
  Gene Name: carboxylesterase 4A
  Uniprot ID: Q5XG92
  ENSP ID: ENSP00000441644
MYVSTRERYKWLRFSEDCLYLNVYAPARAPGDPQLPVMVWFPGGAFIVGAASSYEGSDLAAREKVVLVFLQHRLGIFGFLRWRGRTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 11799 - protein, 463 aa, Homo sapiens
  Payload ID: 2332
  Gene Symbol: CES4A
  Gene Name: carboxylesterase 4A
  Uniprot ID: Q5XG92
  ENSP ID: ENSP00000441907
MYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRDAGLPVYLYEFEHHARGIIVKPRTDGADHGDEMYFLFGGPFATGLSMGKEKALSLQMMKYWANFARTGNPNDGNLPCWPRYNKDEKYLQLDFTTRVGMKLKEKKMAFWMSLYQSQRPEKQRQF

SEQ ID NO: 11800 - protein, 468 aa, Homo sapiens
  Payload ID: 2332
  Gene Symbol: CES4A
  Gene Name: carboxylesterase 4A
  Uniprot ID: Q5XG92
  ENSP ID: ENSP00000444052
MRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRETPMMGICPAGHATTRMKSTCSWILPQEWA

SEQ ID NO: 11801 - protein, 135 aa, Homo sapiens
  Payload ID: 2332
  Gene Symbol: CES4A
  Gene Name: carboxylesterase 4A
  ENSP ID: ENSP00000444182
MYVSTRERYKWLRFSEDCLYLNVYAPARAPGDPQLPVMVWFPGGAFIVGAASSYEGSDLAAREKVVLVFLQHRLGIFGFLRWRGRYPLGPQLWPERRGLARTTATRAGTGGCWTRWRLCAGCRRTSQPSGETQEM

SEQ ID NO: 11802 - protein, 177 aa, Homo sapiens
  Payload ID: 2332
  Gene Symbol: CES4A
  Gene Name: carboxylesterase 4A
  ENSP ID: ENSP00000458664
  MOD_RES (1)..(1): Any amino acid
XALHTKRPQVVTKYGTLQGKQMHVGKTPIQVFLGVPFSRPPLGILRFAPPEPPEPWKGIRDATTYPPGWSLALSPGWSAVARSRLTATSASRVQASLLPQPLSIWGYRCLQESWGQLASMYVSTRERYKWLRFSEDCLYLNVYAPARAPGDPQLPVSDGLVPGRRLHRGRCFFVRGL

SEQ ID NO: 11803 - protein, 575 aa, Homo sapiens
  Payload ID: 2333
  Gene Symbol: CES5A
  Gene Name: carboxylesterase 5A
  Uniprot ID: Q6NT32
  ENSP ID: ENSP00000290567
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 11804 - protein, 525 aa, Homo sapiens
  Payload ID: 2333
  Gene Symbol: CES5A
  Gene Name: carboxylesterase 5A
  Uniprot ID: Q6NT32
  ENSP ID: ENSP00000324271
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHREGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 11805 - protein, 469 aa, Homo sapiens
  Payload ID: 2333
  Gene Symbol: CES5A
  Gene Name: carboxylesterase 5A
  Uniprot ID: Q6NT32
  ENSP ID: ENSP00000428571
MLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 11806 - protein, 604 aa, Homo sapiens
  Payload ID: 2333
  Gene Symbol: CES5A
  Gene Name: carboxylesterase 5A
  Uniprot ID: Q6NT32
  ENSP ID: ENSP00000428864
MAVLVCPASCHGLKEFRIRRGMWRLCLVYYFYPASSTLYVLRIDVLNYTSKDEGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 11807 - protein, 545 aa, Homo sapiens
  Payload ID: 2333
  Gene Symbol: CES5A
  Gene Name: carboxylesterase 5A
  ENSP ID: ENSP00000428887
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 11808 - protein, 75 aa, Homo sapiens
  Payload ID: 2333
  Gene Symbol: CES5A
  Gene Name: carboxylesterase 5A
  ENSP ID: ENSP00000439810
MLKVHYPKFGVSEDCLYLNIYAPAHADTGSKLPVLVWFPGGAFKTGSASIFDGSALAAYEDVLVVVVQYRLGIFG

SEQ ID NO: 11809 - protein, 545 aa, Homo sapiens
  Payload ID: 2333
  Gene Symbol: CES5A
  Gene Name: carboxylesterase 5A
  ENSP ID: ENSP00000458678
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVEFWTSTIPLILSASDMLHSPLSSLTFLSLLQPFFFFCAP

SEQ ID NO: 11810 - protein, 575 aa, Homo sapiens
  Payload ID: 2333
  Gene Symbol: CES5A
  Gene Name: carboxylesterase 5A
  ENSP ID: ENSP00000459314
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVEFWTSTIPLILSASDMLHSPLSSLTFLSLLQPFFFFCAP

SEQ ID NO: 11811 - protein, 75 aa, Homo sapiens; identical to SEQ ID NO: 11808
  Payload ID: 2333
  Gene Symbol: CES5A
  Gene Name: carboxylesterase 5A
  ENSP ID: ENSP00000460292

SEQ ID NO: 11812 - protein, 604 aa, Homo sapiens
  Payload ID: 2333
  Gene Symbol: CES5A
  Gene Name: carboxylesterase 5A
  ENSP ID: ENSP00000460799
MAVLVCPASCHGLKEFRIRRGMWRLCLVYYFYPASSTLYVLRIDVLNYTSKDEGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVEFWTSTIPLILSASDMLHSPLSSLTFLSLLQPFFFFCAP

SEQ ID NO: 11813 - protein, 355 aa, Homo sapiens
  Payload ID: 2333
  Gene Symbol: CES5A
  Gene Name: carboxylesterase 5A
  ENSP ID: ENSP00000460847
MEDDLSWRSWSLLCMEILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVEFWTSTIPLILSASDMLHSPLSSLTFLSLLQPFFFFCAP

SEQ ID NO: 11814 - protein, 525 aa, Homo sapiens
  Payload ID: 2333
  Gene Symbol: CES5A
  Gene Name: carboxylesterase 5A
  ENSP ID: ENSP00000461336
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHREGATEEEKLLSRKMMKYWATFARTGNPNGNDLSLWPAYNLTEQYLQLDLNMSLGQRLKEPRVEFWTSTIPLILSASDMLHSPLSSLTFLSLLQPFFFFCAP

SEQ ID NO: 11815 - protein, 469 aa, Homo sapiens
  Payload ID: 2333
  Gene Symbol: CES5A
  Gene Name: carboxylesterase 5A
  ENSP ID: ENSP00000461519
MLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVEFWTSTIPLILSASDMLHSPLSSLTFLSLLQPFFFFCAP

SEQ ID NO: 11816 - protein, 78 aa, Homo sapiens
  Payload ID: 2333
  Gene Symbol: CES5A
  Gene Name: carboxylesterase 5A
  ENSP ID: ENSP00000461804
MLKVHYPKFGVSEDCLYLNIYAPAHADTGSKLPVLVWFPGGAFKTGSASIFDGSALAAYEDVLVVVVQYRLGIFGFFT

SEQ ID NO: 11817 - protein, 355 aa, Homo sapiens
  Payload ID: 2333
  Gene Symbol: CES5A
  Gene Name: carboxylesterase 5A
  ENSP ID: ENSP00000487767
MEDDLSWRSWSLLCMEILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 11818 - protein, 78 aa, Homo sapiens; identical to SEQ ID NO: 11816
  Payload ID: 2333
  Gene Symbol: CES5A
  Gene Name: carboxylesterase 5A
  ENSP ID: ENSP00000487919

SEQ ID NO: 11819 - protein, 245 aa, Homo sapiens
  Payload ID: 2334
  Gene Symbol: CMBL
  Gene Name: carboxymethylenebutenolidase homolog (Pseudomonas)
  Uniprot ID: Q96DG6
  ENSP ID: ENSP00000296658
MANEAYPCPCDIGHRLEYGGLGREVQVEHIKAYVTKSPVDAGKAVIVIQDIFGWQLPNTRYIADMISGNGYTTIVPDFFVGQEPWDPSGDWSIFPEWLKTRNAQKIDREISAILKYLKQQCHAQKIGIVGFCWGGTAVHHLMMKYSEFRAGVSVYGIVKDSEDIYNLKNPTLFIFAENDVVIPLKDVSLLTQKLKEHCKVEYQIKTFSGQTHGFVHRKREDCSPADKPYIDEARRNLIEWLNKYM

SEQ ID NO: 11820 - protein, 419 aa, Homo sapiens
  Payload ID: 2335
  Gene Symbol: CPA1
  Gene Name: carboxypeptidase A1 (pancreatic)
  Uniprot ID: P15085
  ENSP ID: ENSP00000011292
MRGLLVLSVLLGAVFGKEDFVGHQVLRISVADEAQVQKVKELEDLEHLQLDFWRGPAHPGSPIDVRVPFPSIQAVKIFLESHGISYETMIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWLALLTIMEHTLNHPY

SEQ ID NO: 11821 - protein, 269 aa, Homo sapiens
  Payload ID: 2335
  Gene Symbol: CPA1
  Gene Name: carboxypeptidase A1 (pancreatic)
  ENSP ID: ENSP00000419408
MIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAI

SEQ ID NO: 11822 - protein, 331 aa, Homo sapiens
  Payload ID: 2335
  Gene Symbol: CPA1
  Gene Name: carboxypeptidase A1 (pancreatic)
  ENSP ID: ENSP00000419497
MIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWLALLTIMEHTLNHPY

SEQ ID NO: 11823 - protein, 103 aa, Homo sapiens
  Payload ID: 2335
  Gene Symbol: CPA1
  Gene Name: carboxypeptidase A1 (pancreatic)
  ENSP ID: ENSP00000420218
MIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVW

SEQ ID NO: 11824 - protein, 191 aa, Homo sapiens
  Payload ID: 2335
  Gene Symbol: CPA1
  Gene Name: carboxypeptidase A1 (pancreatic)
  ENSP ID: ENSP00000475021
SLTFPPGSSMRGLLVLSVLLGAVFGKEDFVGHQVLRISVADEAQVQKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTA

SEQ ID NO: 11825 - protein, 419 aa, Homo sapiens
  Payload ID: 2336
  Gene Symbol: CPA2
  Gene Name: carboxypeptidase A2 (pancreatic)
  Uniprot ID: P48052
  ENSP ID: ENSP00000222481
MAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 11826 - protein, 182 aa, Homo sapiens
  Payload ID: 2336
  Gene Symbol: CPA2
  Gene Name: carboxypeptidase A2 (pancreatic)
  ENSP ID: ENSP00000395582
MRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKKSSGRMQKDDGQLNPKPQRQTP

SEQ ID NO: 11827 - protein, 417 aa, Homo sapiens
  Payload ID: 2337
  Gene Symbol: CPA3
  Gene Name: carboxypeptidase A3 (mast cell)
  Uniprot ID: P15088
  ENSP ID: ENSP00000296046
MRLILPVGLIATTLAIAPVRFDREKVFRVKPQDEKQADIIKDLAKTNELDFWYPGATHHVAANMMVDFRVSEKESQAIQSALDQNKMHYEILIHDLQEEIEKQFDVKEDIPGRHSYAKYNNWEKIVAWTEKMMDKYPEMVSRIKIGSTVEDNPLYVLKIGEKNERRKAIFTDCGIHAREWVSPAFCQWFVYQATKTYGRNKIMTKLLDRMNFYILPVFNVDGYIWSWTKNRMWRKNRSKNQNSKCIGTDLNRNFNASWNSIPNTNDPCADNYRGSAPESEKETKAVTNFIRSHLNEIKVYITFHSYSQMLLFPYGYTSKLPPNHEDLAKVAKIGTDVLSTRYETRYIYGPIESTIYPISGSSLDWAYDLGIKHTFAFELRDKGKFGFLLPESRIKPTCRETMLAVKFIAKYILKHTS

SEQ ID NO: 11828 - protein, 421 aa, Homo sapiens
  Payload ID: 2338
  Gene Symbol: CPA4
  Gene Name: carboxypeptidase A4
  Uniprot ID: Q9UI42
  ENSP ID: ENSP00000222482
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 11829 - protein, 388 aa, Homo sapiens
  Payload ID: 2338
  Gene Symbol: CPA4
  Gene Name: carboxypeptidase A4
  Uniprot ID: Q9UI42
  ENSP ID: ENSP00000412947
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 11830 - protein, 171 aa, Homo sapiens
  Payload ID: 2338
  Gene Symbol: CPA4
  Gene Name: carboxypeptidase A4
  ENSP ID: ENSP00000417255
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKIVSDYQRDP

SEQ ID NO: 11831 - protein, 29 aa, Homo sapiens
  Payload ID: 2338
  Gene Symbol: CPA4
  Gene Name: carboxypeptidase A4
  ENSP ID: ENSP00000418276
MQHNEGQERSSNNFNYGAYHSLEAIYHEM

SEQ ID NO: 11832 - protein, 177 aa, Homo sapiens
  Payload ID: 2338
  Gene Symbol: CPA4
  Gene Name: carboxypeptidase A4
  ENSP ID: ENSP00000418392
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQIYHEMDNIAADFPDLARRVKIGHSFENRPMYVLKFSTGKGVRRPAVWLNAGIHSREWISQATAIWTARKIVSDYQRDPAITS

SEQ ID NO: 11833 - protein, 317 aa, Homo sapiens
  Payload ID: 2338
  Gene Symbol: CPA4
  Gene Name: carboxypeptidase A4
  ENSP ID: ENSP00000419660
MQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 11834 - protein, 436 aa, Homo sapiens
  Payload ID: 2339
  Gene Symbol: CPA5
  Gene Name: carboxypeptidase A5
  Uniprot ID: Q8WXQ8
  ENSP ID: ENSP00000376907
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLEEIYSWIDNFVMEHSDIVSKIQIGNSFENQSILVLKFSTGGSRHPAIWIDTGIHSREWITHATGIWTANKIVSDYGKDRVLTDILNAMDIFIELVTNPDGFAFTHSMNRLWRKNKSIRPGIFCIGVDLNRNWKSGFGGNGSNSNPCSETYHGPSPQSEPEVAAIVNFITAHGNFKALISIHSYSQMLMYPYGRLLEPVSNQRELYDLAKDAVEALYKVHGIEYIFGSISTTLYVASGITVDWAYDSGIKYAFSFELRDTGQYGFLLPATQIIPTAQETWMALRTIMEHTLNHPY

SEQ ID NO: 11835 - protein, 403 aa, Homo sapiens
  Payload ID: 2339
  Gene Symbol: CPA5
  Gene Name: carboxypeptidase A5
  Uniprot ID: Q8WXQ8
  ENSP ID: ENSP00000393045
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLEEIYSWIDNFVMEHSDIVSKIQIGNSFENQSILVLKFSTGGSRHPAIWIDTGIHSREWITHATGIWTANKIVSDYGKDRVLTDILNAMDIFIELVTNPDGFAFTHSMNRLWRKNKSIRPGIFCIGVDLNRNWKSGFGGNGSNSNPCSETYHGPSPQSEPEVAAIVNFITAHGNFKALISIHSYSQMLMYPYGRLLEPVSNQRELMWPVGSPSTGPMTVASSTPSALSSGTLGSMASCCRPHRSSPRPRRRGWRFGPSWSTP

SEQ ID NO: 11836 - protein, 436 aa, Homo sapiens; identical to SEQ ID NO: 11834
  Payload ID: 2339
  Gene Symbol: CPA5
  Gene Name: carboxypeptidase A5
  Uniprot ID: Q8WXQ8
  ENSP ID: ENSP00000417314

SEQ ID NO: 11837 - protein, 85 aa, Homo sapiens
  Payload ID: 2339
  Gene Symbol: CPA5
  Gene Name: carboxypeptidase A5
  ENSP ID: ENSP00000417886
  MOD_RES (1)..(1): Any amino acid
XSIRPGIFCIGVDLNRNWKSGFGDVASGITVDWAYDSGIKYAFSFELRDTGQYGFLLPATQIIPTAQETWMALRTIMEHTLNHPY

SEQ ID NO: 11838 - protein, 436 aa, Homo sapiens; identical to SEQ ID NO: 11834
  Payload ID: 2339
  Gene Symbol: CPA5
  Gene Name: carboxypeptidase A5
  Uniprot ID: Q8WXQ8
  ENSP ID: ENSP00000418183

SEQ ID NO: 11839 - protein, 8 aa, Homo sapiens
  Payload ID: 2339
  Gene Symbol: CPA5
  Gene Name: carboxypeptidase A5
  ENSP ID: ENSP00000419013
MQGTPGGG

SEQ ID NO: 11840 - protein, 436 aa, Homo sapiens; identical to SEQ ID NO: 11834
  Payload ID: 2339
  Gene Symbol: CPA5
  Gene Name: carboxypeptidase A5
  Uniprot ID: Q8WXQ8
  ENSP ID: ENSP00000419025

SEQ ID NO: 11841 - protein, 32 aa, Homo sapiens
  Payload ID: 2339
  Gene Symbol: CPA5
  Gene Name: carboxypeptidase A5
  ENSP ID: ENSP00000419778
MQGTPGGGTRPGPSPVDRRTLLVFSFILAAAL

SEQ ID NO: 11842 - protein, 123 aa, Homo sapiens
  Payload ID: 2339
  Gene Symbol: CPA5
  Gene Name: carboxypeptidase A5
  ENSP ID: ENSP00000420060
MQGTPGGGTRPGPSPVDRRTLLVFSFILAAALGQMNFTGDQVLRVLAKDEKQLSLLGDLEGLKPQKVDFWRGPARPSLPVDMRVPFSELKDIKAYLESHGLAYSIMIKDIQVLLDEERQAMAK

SEQ ID NO: 11843 - protein, 436 aa, Homo sapiens; identical to SEQ ID NO: 11834
  Payload ID: 2339
  Gene Symbol: CPA5
  Gene Name: carboxypeptidase A5
  Uniprot ID: Q8WXQ8
  ENSP ID: ENSP00000420237

SEQ ID NO: 11844 - protein, 437 aa, Homo sapiens
  Payload ID: 2340
  Gene Symbol: CPA6
  Gene Name: carboxypeptidase A6
  Uniprot ID: Q8N4T0
  ENSP ID: ENSP00000297770
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDEGASMHPCDDTYCGPFPESEPEVKAVANFLRKHRKHIRAYLSFHAYAQMLLYPYSYKYATIPNFRCVESAAYKAVNALQSVYGVRYRYGPASTTLYVSSGSSMDWAYKNGIPYAFAFELRDTGYFGFLLPEMLIKPTCTETMLAVKNITMHLLKKCP

SEQ ID NO: 11845 - protein, 92 aa, Homo sapiens
  Payload ID: 2340
  Gene Symbol: CPA6
  Gene Name: carboxypeptidase A6
  ENSP ID: ENSP00000419016
MKCLGKRRGQAAAFLPLCWLFLKILQPGHSHLYNNRYAGDKVIRFIPKTEEEAYALKKISYQLKGPHRRSSENTGEGKQLAHPEKPKIPLWI

SEQ ID NO: 11846 - protein, 315 aa, Homo sapiens
  Payload ID: 2340
  Gene Symbol: CPA6
  Gene Name: carboxypeptidase A6
  Uniprot ID: Q8N4T0
  ENSP ID: ENSP00000431112
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCGKFGTNWDPDPKVSAGFTLQNMSPEDSHGRLMFFCM

SEQ ID NO: 11847 - protein, 417 aa, Homo sapiens
  Payload ID: 2341
  Gene Symbol: CPB1
  Gene Name: carboxypeptidase B1 (tissue)
  Uniprot ID: P15086
  ENSP ID: ENSP00000282957
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 11848 - protein, 99 aa, Homo sapiens
  Payload ID: 2341
  Gene Symbol: CPB1
  Gene Name: carboxypeptidase B1 (tissue)
  ENSP ID: ENSP00000417117
MLALLVLVTVALASAHHGGEHFEGEKVFRVNVEDENHINIIRELASTTQIDFWKPDSVTQIKPHSTVDFRVKAEDTVTVENVLKQNELQYKVLISNLRN

SEQ ID NO: 11849 - protein, 417 aa, Homo sapiens; identical to SEQ ID NO: 11847
  Payload ID: 2341
  Gene Symbol: CPB1
  Gene Name: carboxypeptidase B1 (tissue)
  Uniprot ID: P15086
  ENSP ID: ENSP00000417222

SEQ ID NO: 11850 - protein, 59 aa, Homo sapiens
  Payload ID: 2341
  Gene Symbol: CPB1
  Gene Name: carboxypeptidase B1 (tissue)
  ENSP ID: ENSP00000419114
MLALLVLVTVALASAHHGGEHFEGEKVFRVNVEDENHINIIRELASTTQIDFWKPDSVT

SEQ ID NO: 11851 - protein, 203 aa, Homo sapiens
  Payload ID: 2341
  Gene Symbol: CPB1
  Gene Name: carboxypeptidase B1 (tissue)
  ENSP ID: ENSP00000419427
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETVGKAGQNKPAIFMDCGFHAREWISPAFCQWFVREAVRTYGREIQVTELLDKLDFYVLPVLNIDGYIYTWTKSRFWRKTR

SEQ ID NO: 11852 - protein, 423 aa, Homo sapiens
  Payload ID: 2342
  Gene Symbol: CPB2
  Gene Name: carboxypeptidase B2 (plasma)
  Uniprot ID: Q96IY4
  ENSP ID: ENSP00000181383
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 11853 - protein, 386 aa, Homo sapiens
  Payload ID: 2342
  Gene Symbol: CPB2
  Gene Name: carboxypeptidase B2 (plasma)
  ENSP ID: ENSP00000400714
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 11854 - protein, 1380 aa, Homo sapiens
  Payload ID: 2343
  Gene Symbol: CPD
  Gene Name: carboxypeptidase D
  Uniprot ID: O75976
  ENSP ID: ENSP00000225719
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 11855 - protein, 1133 aa, Homo sapiens
  Payload ID: 2343
  Gene Symbol: CPD
  Gene Name: carboxypeptidase D
  Uniprot ID: O75976
  ENSP ID: ENSP00000444443
MRFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 11856 - protein, 184 aa, Homo sapiens
  Payload ID: 2343
  Gene Symbol: CPD
  Gene Name: carboxypeptidase D
  ENSP ID: ENSP00000463763
VHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGPKNLLLSSQIVFYIH

SEQ ID NO: 11857 - protein, 82 aa, Homo sapiens
  Payload ID: 2343
  Gene Symbol: CPD
  Gene Name: carboxypeptidase D
  ENSP ID: ENSP00000464255
NARGKDLDTDFTNNASQPETKAIIENLIQKQDFSLSVALDGGSMLVTYPYDKPVQTVENKETLKHLASLYANNHPSMHMVLW

SEQ ID NO: 11858 - protein, 40 aa, Homo sapiens
  Payload ID: 2343
  Gene Symbol: CPD
  Gene Name: carboxypeptidase D
  ENSP ID: ENSP00000466049
  MOD_RES (1)..(1): Any amino acid
XVGTELLLALAEFLCLNYKKNPAVTQMGERELKRKTVLQK

SEQ ID NO: 11859 - protein, 476 aa, Homo sapiens
  Payload ID: 2344
  Gene Symbol: CPE
  Gene Name: carboxypeptidase E
  Uniprot ID: P16870
  ENSP ID: ENSP00000386104
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 11860 - protein, 147 aa, Homo sapiens
  Payload ID: 2344
  Gene Symbol: CPE
  Gene Name: carboxypeptidase E
  ENSP ID: ENSP00000416601
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYD

SEQ ID NO: 11861 - protein, 157 aa, Homo sapiens
  Payload ID: 2344
  Gene Symbol: CPE
  Gene Name: carboxypeptidase E
  ENSP ID: ENSP00000423699
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEY

SEQ ID NO: 11862 - protein, 139 aa, Homo sapiens
  Payload ID: 2344
  Gene Symbol: CPE
  Gene Name: carboxypeptidase E
  ENSP ID: ENSP00000424830
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGD

SEQ ID NO: 11863 - protein, 108 aa, Homo sapiens
  Payload ID: 2344
  Gene Symbol: CPE
  Gene Name: carboxypeptidase E
  ENSP ID: ENSP00000427629
  MOD_RES (1)..(1): Any amino acid
XLGAEAQEPGAPAAGMRRRRRLQQEDGISFEYHRYPELREALVSVWLQCTAISRIYTVGRSFEGRELLVIELSDNPGVHEPDCKLYEVGTLIPAPSSCLAHSGLEYTL

SEQ ID NO: 11864 - protein, 443 aa, Homo sapiens
  Payload ID: 2345
  Gene Symbol: CPM
  Gene Name: carboxypeptidase M
  Uniprot ID: P14384
  ENSP ID: ENSP00000339157
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 11865 - protein, 64 aa, Homo sapiens
  Payload ID: 2345
  Gene Symbol: CPM
  Gene Name: carboxypeptidase M
  ENSP ID: ENSP00000446573
MDFPCLWLGLLLPLVAALDFNYHRQEGMEAFLKTVAQNYSSVTHLHSIGKSVKDCWAGAAAPSD

SEQ ID NO: 11866 - protein, 249 aa, Homo sapiens
  Payload ID: 2345
  Gene Symbol: CPM
  Gene Name: carboxypeptidase M
  ENSP ID: ENSP00000446799
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFP

SEQ ID NO: 11867 - protein, 35 aa, Homo sapiens
  Payload ID: 2345
  Gene Symbol: CPM
  Gene Name: carboxypeptidase M
  ENSP ID: ENSP00000447051
SCPMIPLYRNLPDHSAATKPSLFLFLVSLLHIFFK

SEQ ID NO: 11868 - protein, 443 aa, Homo sapiens; identical to SEQ ID NO: 11864
  Payload ID: 2345
  Gene Symbol: CPM
  Gene Name: carboxypeptidase M
  Uniprot ID: P14384
  ENSP ID: ENSP00000447255

SEQ ID NO: 11869 - protein, 198 aa, Homo sapiens
  Payload ID: 2345
  Gene Symbol: CPM
  Gene Name: carboxypeptidase M
  ENSP ID: ENSP00000447455
  MOD_RES (1)..(1): Any amino acid
XPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKLRSFACNRGQDEFCLTSLMS

SEQ ID NO: 11870 - protein, 72 aa, Homo sapiens
  Payload ID: 2345
  Gene Symbol: CPM
  Gene Name: carboxypeptidase M
  ENSP ID: ENSP00000448078
MDFPCLWLGLLLPLVAALDFNYHRQEGMEAFLKTVAQNYSSVTHLHSIGKSVKETCGFLLWGGFQRNTELGF

SEQ ID NO: 11871 - protein, 443 aa, Homo sapiens; identical to SEQ ID NO: 11864
  Payload ID: 2345
  Gene Symbol: CPM
  Gene Name: carboxypeptidase M
  Uniprot ID: P14384
  ENSP ID: ENSP00000448517

SEQ ID NO: 11872 - protein, 136 aa, Homo sapiens
  Payload ID: 2345
  Gene Symbol: CPM
  Gene Name: carboxypeptidase M
  ENSP ID: ENSP00000449911
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKP

SEQ ID NO: 11873 - protein, 64 aa, Homo sapiens; identical to SEQ ID NO: 11865
  Payload ID: 2345
  Gene Symbol: CPM
  Gene Name: carboxypeptidase M
  ENSP ID: ENSP00000450400

SEQ ID NO: 11874 - protein, 458 aa, Homo sapiens
  Payload ID: 2346
  Gene Symbol: CPN1
  Gene Name: carboxypeptidase N, polypeptide 1
  Uniprot ID: P15169
  ENSP ID: ENSP00000359446
MSDLLSVFLHLLLLFKLVAPVTFRHHRYDDLVRTLYKVQNECPGITRVYSIGRSVEGRHLYVLEFSDHPGIHEPLEPEVKYVGNMHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 11875 - protein, 204 aa, Homo sapiens
  Payload ID: 2346
  Gene Symbol: CPN1
  Gene Name: carboxypeptidase N, polypeptide 1
  ENSP ID: ENSP00000410895
MHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAE

SEQ ID NO: 11876 - protein, 545 aa, Homo sapiens
  Payload ID: 2347
  Gene Symbol: CPN2
  Gene Name: carboxypeptidase N, polypeptide 2
  Uniprot ID: P22792
  ENSP ID: ENSP00000319464
MLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVAEGTFAHLSNLRSLMLSYNAITHLPAGIFRDLEELVKLYLGSNNLTALHPALFQNLSKLELLSLSKNQLTTLPEGIFDTNYNLFNLALHGNPWQCDCHLAYLFNWLQQYTDRLLNIQTYCAGPAYLKGQVVPALNEKQLVCPVTRDHLGFQVTWPDESKAGGSWDLAVQERAARSQCTYSNPEGTVVLACDQAQCRWLNVQLSPQQGSLGLQYNASQEWDLRSSCGSLRLTVSIEARAAGP

SEQ ID NO: 11877 - protein, 545 aa, Homo sapiens; identical to SEQ ID NO: 11876
  Payload ID: 2347
  Gene Symbol: CPN2
  Gene Name: carboxypeptidase N, polypeptide 2
  Uniprot ID: P22792
  ENSP ID: ENSP00000402232

SEQ ID NO: 11878 - protein, 374 aa, Homo sapiens
  Payload ID: 2348
  Gene Symbol: CPO
  Gene Name: carboxypeptidase O
  Uniprot ID: Q8IVL8
  ENSP ID: ENSP00000272852
MKPLLETLYLLGMLVPGGLGYDRSLAQHRQEIVDKSVSPWSLETYSYNIYHPMGEIYEWMREISEKYKEVVTQHFLGVTYETHPMYYLKISQPSGNPKKIIWMDCGIHAREWIAPAFCQWFVKEILQNHKDNSSIRKLLRNLDFYVLPVLNIDGYIYTWTTDRLWRKSRSPHNNGTCFGTDLNRNFNASWCSIGASRNCQDQTFCGTGPVSEPETKAVASFIESKKDDILCFLTMHSYGQLILTPYGYTKNKSSNHPEMIQVGQKAANALKAKYGTNYRVGSSADILYASSGSSRDWARDIGIPFSYTFELRDSGTYGFVLPEAQIQPTCEETMEAVLSVLDDVYAKHWHSDSAGRVTSATMLLGLLVSCMSLL

SEQ ID NO: 11879 - protein, 472 aa, Homo sapiens
  Payload ID: 2349
  Gene Symbol: CPQ
  Gene Name: carboxypeptidase Q
  Uniprot ID: Q9Y646
  ENSP ID: ENSP00000220763
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 11880 - protein, 130 aa, Homo sapiens
  Payload ID: 2349
  Gene Symbol: CPQ
  Gene Name: carboxypeptidase Q
  ENSP ID: ENSP00000429134
  MOD_RES (1)..(1): Any amino acid
XFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 11881 - protein, 186 aa, Homo sapiens
  Payload ID: 2349
  Gene Symbol: CPQ
  Gene Name: carboxypeptidase Q
  ENSP ID: ENSP00000429146
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQY

SEQ ID NO: 11882 - protein, 130 aa, Homo sapiens
  Payload ID: 2349
  Gene Symbol: CPQ
  Gene Name: carboxypeptidase Q
  ENSP ID: ENSP00000429934
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKI

SEQ ID NO: 11883 - protein, 131 aa, Homo sapiens
  Payload ID: 2349
  Gene Symbol: CPQ
  Gene Name: carboxypeptidase Q
  ENSP ID: ENSP00000431024
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIA

SEQ ID NO: 11884 - protein, 137 aa, Homo sapiens
  Payload ID: 2349
  Gene Symbol: CPQ
  Gene Name: carboxypeptidase Q
  ENSP ID: ENSP00000431114
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGS

SEQ ID NO: 11885 - protein, 734 aa, Homo sapiens
  Payload ID: 2350
  Gene Symbol: CPXM1
  Gene Name: carboxypeptidase X (M14 family), member 1
  Uniprot ID: Q96SM3
  ENSP ID: ENSP00000369979
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 11886 - protein, 756 aa, Homo sapiens
  Payload ID: 2351
  Gene Symbol: CPXM2
  Gene Name: carboxypeptidase X (M14 family), member 2
  Uniprot ID: Q8N436
  ENSP ID: ENSP00000241305
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGQKRRQRG

SEQ ID NO: 11887 - protein, 224 aa, Homo sapiens
  Payload ID: 2351
  Gene Symbol: CPXM2
  Gene Name: carboxypeptidase X (M14 family), member 2
  ENSP ID: ENSP00000483180
MEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTGRVSLQKLSLACRRVRCAFALSSSSTMIVRPPQPYGTVPHSSPDPVTTKISPLRNF

SEQ ID NO: 11888 - protein, 641 aa, Homo sapiens
  Payload ID: 2352
  Gene Symbol: CPZ
  Gene Name: carboxypeptidase Z
  Uniprot ID: Q66K79
  ENSP ID: ENSP00000315074
MPPPLPLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 11889 - protein, 652 aa, Homo sapiens
  Payload ID: 2352
  Gene Symbol: CPZ
  Gene Name: carboxypeptidase Z
  Uniprot ID: Q66K79
  ENSP ID: ENSP00000354255
MPPPLPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 11890 - protein, 515 aa, Homo sapiens
  Payload ID: 2352
  Gene Symbol: CPZ
  Gene Name: carboxypeptidase Z
  Uniprot ID: Q66K79
  ENSP ID: ENSP00000371920
MAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 11891 - protein, 69 aa, Homo sapiens
  Payload ID: 2352
  Gene Symbol: CPZ
  Gene Name: carboxypeptidase Z
  ENSP ID: ENSP00000422693
MPPPLPLLLLTVLVVAAARPGCEFERNPAGECHRPPAADSGTVPGPPWLLFCRRAAAPTLSEHFRQLNP

SEQ ID NO: 11892 - protein, 476 aa, Homo sapiens
  Payload ID: 2353
  Gene Symbol: CPVL
  Gene Name: carboxypeptidase, vitellogenic-like
  Uniprot ID: Q9H3G5
  ENSP ID: ENSP00000265394
MVGAMWKVIVSLVLLMPGPCDGLFRSLYRSVSMPPKGDSGQPLFLTPYIEAGKIQKGRELSLVGPFPGLNMKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 11893 - protein, 476 aa, Homo sapiens; identical to SEQ ID NO: 11892
  Payload ID: 2353
  Gene Symbol: CPVL
  Gene Name: carboxypeptidase, vitellogenic-like
  Uniprot ID: Q9H3G5
  ENSP ID: ENSP00000379572

SEQ ID NO: 11894 - protein, 476 aa, Homo sapiens; identical to SEQ ID NO: 11892
  Payload ID: 2353
  Gene Symbol: CPVL
  Gene Name: carboxypeptidase, vitellogenic-like
  Uniprot ID: Q9H3G5
  ENSP ID: ENSP00000387164

SEQ ID NO: 11895 - protein, 141 aa, Homo sapiens
  Payload ID: 2353
  Gene Symbol: CPVL
  Gene Name: carboxypeptidase, vitellogenic-like
  ENSP ID: ENSP00000395690
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVP

SEQ ID NO: 11896 - protein, 180 aa, Homo sapiens
  Payload ID: 2353
  Gene Symbol: CPVL
  Gene Name: carboxypeptidase, vitellogenic-like
  ENSP ID: ENSP00000397327
  MOD_RES (1)..(1): Any amino acid
XKYFQKQCHECIEHIRKQNWFEAFEEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 11897 - protein, 141 aa, Homo sapiens
  Payload ID: 2353
  Gene Symbol: CPVL
  Gene Name: carboxypeptidase, vitellogenic-like
  ENSP ID: ENSP00000403580
IIGGYAEFLYQIGLLDEKQKKYFQKQCHECIEHIRKQNWFEAFEVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 11898 - protein, 244 aa, Homo sapiens
  Payload ID: 2353
  Gene Symbol: CPVL
  Gene Name: carboxypeptidase, vitellogenic-like
  ENSP ID: ENSP00000409036
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNY

SEQ ID NO: 11899 - protein, 43 aa, Homo sapiens
  Payload ID: 2353
  Gene Symbol: CPVL
  Gene Name: carboxypeptidase, vitellogenic-like
  ENSP ID: ENSP00000412857
MVGAMWKVIVSLVLLMPGPCDGLFRSLYRSVSMPPKGDSGQPL

SEQ ID NO: 11900 - protein, 52 aa, Homo sapiens
  Payload ID: 2353
  Gene Symbol: CPVL
  Gene Name: carboxypeptidase, vitellogenic-like
  ENSP ID: ENSP00000413287
MVGAMWKVIVSLVLLMPGPCDGLFRSLYRSVSMPPKGDSGQPLFLTPYIEAG

SEQ ID NO: 11901 - protein, 6 aa, Homo sapiens
  Payload ID: 2353
  Gene Symbol: CPVL
  Gene Name: carboxypeptidase, vitellogenic-like
  ENSP ID: ENSP00000416555
MVGAMW

SEQ ID NO: 11902 - protein, 100 aa, Homo sapiens
  Payload ID: 2353
  Gene Symbol: CPVL
  Gene Name: carboxypeptidase, vitellogenic-like
  ENSP ID: ENSP00000417015
MFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHL

SEQ ID NO: 11903 - protein, 232 aa, Homo sapiens
  Payload ID: 2353
  Gene Symbol: CPVL
  Gene Name: carboxypeptidase, vitellogenic-like
  ENSP ID: ENSP00000479581
MFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAPRGESDF

SEQ ID NO: 11904 - protein, 230 aa, Homo sapiens
  Payload ID: 2353
  Gene Symbol: CPVL
  Gene Name: carboxypeptidase, vitellogenic-like
  ENSP ID: ENSP00000481092
MFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFCHSQRDKPRGESDF

SEQ ID NO: 11905 - protein, 526 aa, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENSP ID: ENSP00000161559
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 11906 - protein, 430 aa, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENSP ID: ENSP00000244291
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 11907 - protein, 461 aa, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENSP ID: ENSP00000351165
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTERQNLTMLPRLDSNSWAQAILPSVSQSAEITDNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 11908 - protein, 368 aa, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENSP ID: ENSP00000384083
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTDNALPQENGLSPGAIAGIVIGVVALVALIAVALACFLHFGKTGSSGPLQ

SEQ ID NO: 11909 - protein, 464 aa, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENSP ID: ENSP00000384709
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGSSGPLQ

SEQ ID NO: 11910 - protein, 99 aa, Homo sapiens
  Payload ID: 2354
  Gene Symbol: CEACAM1
  Gene Name: carcinoembryonic antigen-related cell adhesion molecule 1 (biliary glycoprotein)
  ENSP ID: ENSP00000471566
MPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFH

SEQ ID NO: 11911 - protein, 399 aa, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENSP ID: ENSP00000471918
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTEMAFHHVAKAGLKLLSSSNPPASTSQSAKITDNALPQENGLSPGAIAGIVIGVVALVALIAVALACFLHFGKTGSSGPLQ

SEQ ID NO: 11912 - protein, 94 aa, Homo sapiens
  Payload ID: 2354
  Gene Symbol: CEACAM1
  Gene Name: carcinoembryonic antigen-related cell adhesion molecule 1 (biliary glycoprotein)
  ENSP ID: ENSP00000472633
MPFNVAEGKEVLLLVHNLPQQLFGYSWYKGERVDGNRQIVGYAIGTQQATPGPANSGRETIYPNASLLIQNVTQNDTGFYTLQVIKSDLVNEEA

SEQ ID NO: 11913 - protein, 425 aa, Homo sapiens
  Payload ID: 2355
  Gene Symbol: CEACAM16
  Gene Name: carcinoembryonic antigen-related cell adhesion molecule 16
  Uniprot ID: Q2WEN9
  ENSP ID: ENSP00000385576
MALTGYSWLLLSATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVALRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVAPLG

SEQ ID NO: 11914 - protein, 425 aa, Homo sapiens; identical to SEQ ID NO: 11913
  Payload ID: 2355
  Gene Symbol: CEACAM16
  Gene Name: carcinoembryonic antigen-related cell adhesion molecule 16
  Uniprot ID: Q2WEN9
  ENSP ID: ENSP00000466561

SEQ ID NO: 11915 - protein, 384 aa, Homo sapiens
  Payload ID: 2356
  Gene Symbol: CEACAM18
  Gene Name: carcinoembryonic antigen-related cell adhesion molecule 18
  Uniprot ID: A8MTB9
  ENSP ID: ENSP00000379738
MDLSRPRWSLWRRVFLMASLLACGICQASGQIFITQTLGIKGYRTVVALDKVPEDVQEYSWYWGANDSAGNMIISHKPPSAQQPGPMYTGRERVNREGSLLIRPTALNDTGNYTVRVVAGNETQRATGWLEVLELGSNLGISVNASSLVENMDSVAADCLTNVTNITWYVNDVPTSSSDRMTISPDGKTLVILRVSRYDRTIQCMIESFPEIFQRSERISLTVAYGPDYVLLRSNPDDFNGIVTAEIGSQVEMECICYSFLDLKYHWIHNGSLLNFSDAKMNLSSLAWEQMGRYRCTVENPVTQLIMYMDVRIQAPHEDLTCCPQRFLHLRIHGDVPHHADSAGWRLHLWSPDPCSDQPLLNQDKSGSMSVHPRPEDKTRRASR

SEQ ID NO: 11916 - protein, 299 aa, Homo sapiens
  Payload ID: 2357
  Gene Symbol: CEACAM19
  Gene Name: carcinoembryonic antigen-related cell adhesion molecule 19
  Uniprot ID: Q7Z692
  ENSP ID: ENSP00000351627
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQDLLNPDPAPYCQLVPTS

SEQ ID NO: 11917 - protein, 300 aa, Homo sapiens
  Payload ID: 2357
  Gene Symbol: CEACAM19
  Gene Name: carcinoembryonic antigen-related cell adhesion molecule 19
  Uniprot ID: Q7Z692
  ENSP ID: ENSP00000384887
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 11918 - protein, 56 aa, Homo sapiens
  Payload ID: 2357
  Gene Symbol: CEACAM19
  Gene Name: carcinoembryonic antigen-related cell adhesion molecule 19
  ENSP ID: ENSP00000465422
MEIPMGTQGCFSKSLLLSASILVLWMLQGSQAALYIQKIPEQPQKNQDLLLSVQGV

SEQ ID NO: 11919 - protein, 56 aa, Homo sapiens; identical to SEQ ID NO: 11918
  Payload ID: 2357
  Gene Symbol: CEACAM19
  Gene Name: carcinoembryonic antigen-related cell adhesion molecule 19
  ENSP ID: ENSP00000466592

SEQ ID NO: 11920 - protein, 54 aa, Homo sapiens
  Payload ID: 2357
  Gene Symbol: CEACAM19
  Gene Name: carcinoembryonic antigen-related cell adhesion molecule 19
  ENSP ID: ENSP00000480588
MEIPMGTQGCFSKSLLLSASILVLWMLQGSQAALYIQKIPEQPQKNQDLLLSVQ

SEQ ID NO: 11921 - protein, 56 aa, Homo sapiens; identical to SEQ ID NO: 11918
  Payload ID: 2357
  Gene Symbol: CEACAM19
  Gene Name: carcinoembryonic antigen-related cell adhesion molecule 19
  ENSP ID: ENSP00000481453

SEQ ID NO: 11922 - protein, 56 aa, Homo sapiens; identical to SEQ ID NO: 11918
  Payload ID: 2357
  Gene Symbol: CEACAM19
  Gene Name: carcinoembryonic antigen-related cell adhesion molecule 19
  ENSP ID: ENSP00000483240

SEQ ID NO: 11923 - protein, 585 aa, Homo sapiens
  Payload ID: 2358
  Gene Symbol: CEACAM20
  Gene Name: carcinoembryonic antigen-related cell adhesion molecule 20
  ENSP ID: ENSP00000480940
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAGIVIGILAVIAVASELGYFLCIRNARRPSRKTTEDPSHETSQPIPKEEHPTEPSSESLSPEYRNISQLQGRIRVELMQPPDLPEETYETKLPSASRRGNSFSPWKPPPKPLMPPLRLVSTVPKNMESIYEVLGMQQ

SEQ ID NO: 11924 - protein, 491 aa, Homo sapiens
  Payload ID: 2358
  Gene Symbol: CEACAM20
  Gene Name: carcinoembryonic antigen-related cell adhesion molecule 20
  ENSP ID: ENSP00000481812
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINCPQSSSLSSGAIAGIVIGILAVIAVASELGYFLCIRNARRPSRKTTEDPSHETSQPIPKEEHPTEPSSESLSPEYRNISQLQGRIRVELTKLPSASRRGNSFSPWKPPPKPLMPPLRLVSTVPKNMESIYEELVNPEPNTYIQINPSV

SEQ ID NO: 11925 - protein, 596 aa, Homo sapiens
  Payload ID: 2358
  Gene Symbol: CEACAM20
  Gene Name: carcinoembryonic antigen-related cell adhesion molecule 20
  ENSP ID: ENSP00000481937
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAGIVIGILAVIAVASELGYFLCIRNARRPSRKTTEDPSHETSQPIPKEEHPTEPSSESLSPEYRNISQLQGRIRVELMQPPDLPEETYETKLPSASRRGNSFSPWKPPPKPLMPPLRLVSTVPKNMESIYEELVNPEPNTYIQINPSV

SEQ ID NO: 11926 - protein, 503 aa, Homo sapiens
  Payload ID: 2358
  Gene Symbol: CEACAM20
  Gene Name: carcinoembryonic antigen-related cell adhesion molecule 20
  ENSP ID: ENSP00000482943
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINCPQSSSLSSGAIAGIVIGILAVIAVASELGYFLCIRNARRPSRKTTEDPSHETSQPIPKEEHPTEPSSESLSPEYRNISQLQGRIRVELMQPPDLPEETYETKLPSASRRGNSFSPWKPPPKPLMPPLRLVSTVPKNMESIYEELVNPEPNTYIQINPSV

SEQ ID NO: 11927 - protein, 584 aa, Homo sapiens
  Payload ID: 2358
  Gene Symbol: CEACAM20
  Gene Name: carcinoembryonic antigen-related cell adhesion molecule 20
  ENSP ID: ENSP00000483639
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAGIVIGILAVIAVASELGYFLCIRNARRPSRKTTEDPSHETSQPIPKEEHPTEPSSESLSPEYRNISQLQGRIRVELMQPPDLPEETYETKLPSASRRGNSFSPWKPPPKPLMPPLRLVSTVPKNMESIYEVFMPH

SEQ ID NO: 11928 - protein, 584 aa, Homo sapiens
  Payload ID: 2358
  Gene Symbol: CEACAM20
  Gene Name: carcinoembryonic antigen-related cell adhesion molecule 20
  ENSP ID: ENSP00000483912
MGPADSWGHHWMGILLSASLCTVWSPPAAAQLTLNANPLDATQSEDVVLPVFGTPRTPQIHGRSRELAKPSIAVSPGTAIEQKDMVTFYCTTKDVNITIHWVSNNLSIVFHERMQLSKDGKILTILIVQREDSGTYQCEARDALLSQRSDPIFLDVKYGPDPVEIKLESGVASGEVVEVMEGSSMTFLAETKSHPPCAYTWFLLDSILSHTTRTFTIHAVSREHEGLYRCLVSNSATHLSSLGTLKVRVLETLTMPQVVPSSLNLVENARSVDLTCQTVNQSVNVQWFLSGQPLLPSEHLQLSADNRTLIIHGLQRNDTGPYACEVWNWGSRARSEPLELTINYGPDQVHITRESASEMISTIEAELNSSLTLQCWAESKPGAEYRWTLEHSTGEHLGEQLIIRALTWEHDGIYNCTASNSLTGLARSTSVLVKVVGPQSSSLSSGAIAGIVIGILAVIAVASELGYFLCIRNARRPSRKTTEDPSHETSQPIPKEEHPTEPSSESLSPEYRNISQLQGRIRVELTKLPSASRRGNSFSPWKPPPKPLMPPLRLVSTVPKNMESIYEELVNPEPNTYIQINPSV

SEQ ID NO: 11929 - protein, 292 aa, Homo sapiens
  Payload ID: 2359
  Gene Symbol: CEACAM21
  Gene Name: carcinoembryonic antigen-related cell adhesion molecule 21
  Uniprot ID: Q3KPI0
  ENSP ID: ENSP00000187608
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYNLQVTYRNSQIEQASHHLRVYESVAQPSIQASSTTVTEKGSVVLTCHTNNTGTSFQWIFNNQRLQVTKRMKLSWFNHVLTIDPIRQEDAGEYQCEVSNPVSSNRSDPLKLTVKYDNTLGILIGVLVGSLLVAALVCFLLLRKTGRASDQSDFREQQPPASTPGHGPSDSSIS

SEQ ID NO: 11930 - protein, 165 aa, Homo sapiens
  Payload ID: 2359
  Gene Symbol: CEACAM21
  Gene Name: carcinoembryonic antigen-related cell adhesion molecule 21
  ENSP ID: ENSP00000384380
MAPRHFLLVTLSTESVAQPSIQASSTTVTEKGSVVLTCHTNNTGTSFQWIFNNQRLQVTKRMKLSWFNHVLTIDPIRQEDAGEYQCEVSNPVSSNRSDPLKLTVKSDDNTLGILIGVLVGSLLVAALVCFLLLRKTGRASDQSDFREQQPPASTPGHGPSDSSIS

SEQ ID NO: 11931 - protein, 293 aa, Homo sapiens
  Payload ID: 2359
  Gene Symbol: CEACAM21
  Gene Name: carcinoembryonic antigen-related cell adhesion molecule 21
  Uniprot ID: Q3KPI0
  ENSP ID: ENSP00000385739
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYNLQVTYRNSQIEQASHHLRVYESVAQPSIQASSTTVTEKGSVVLTCHTNNTGTSFQWIFNNQRLQVTKRMKLSWFNHVLTIDPIRQEDAGEYQCEVSNPVSSNRSDPLKLTVKSDDNTLGILIGVLVGSLLVAALVCFLLLRKTGRASDQSDFREQQPPASTPGHGPSDSSIS

SEQ ID NO: 11932 - protein, 191 aa, Homo sapiens
  Payload ID: 2359
  Gene Symbol: CEACAM21
  Gene Name: carcinoembryonic antigen-related cell adhesion molecule 21
  Uniprot ID: Q3KPI0
  ENSP ID: ENSP00000390697
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYNLQVTYRNSQIEQASHHLRVYGECSKFDSEISEDAAWPQDTFCWSLYPQSQWLSPPSKPAAPQSQRRAPWS

SEQ ID NO: 11933 - protein, 165 aa, Homo sapiens; identical to SEQ ID NO: 11930
  Payload ID: 2359
  Gene Symbol: CEACAM21
  Gene Name: carcinoembryonic antigen-related cell adhesion molecule 21
  ENSP ID: ENSP00000482379

SEQ ID NO: 11934 - protein, 292 aa, Homo sapiens; identical to SEQ ID NO: 11929
  Payload ID: 2359
  Gene Symbol: CEACAM21
  Gene Name: carcinoembryonic antigen-related cell adhesion molecule 21
  Uniprot ID: Q3KPI0
  ENSP ID: ENSP00000483598

SEQ ID NO: 11935 - protein, 191 aa, Homo sapiens; identical to SEQ ID NO: 11932
  Payload ID: 2359
  Gene Symbol: CEACAM21
  Gene Name: carcinoembryonic antigen-related cell adhesion molecule 21
  ENSP ID: ENSP00000487327

SEQ ID NO: 11936 - protein, 293 aa, Homo sapiens; identical to SEQ ID NO: 11931
  Payload ID: 2359
  Gene Symbol: CEACAM21
  Gene Name: carcinoembryonic antigen-related cell adhesion molecule 21
  ENSP ID: ENSP00000487532

SEQ ID NO: 11937 - protein, 95 aa, Homo sapiens
  Payload ID: 2359
  Gene Symbol: CEACAM21
  Gene Name: carcinoembryonic antigen-related cell adhesion molecule 21
  ENSP ID: ENSP00000488260
  MOD_RES (1)..(1): Any amino acid
XLTIDPIRQEDAGEYQCEVSNPVSSNRSDPLKLTVKYDNTLGILIGVLVGSLLVAALVCFLLLRKTGRASDQSDFREQQPPASTPGHGPSDSSIS

SEQ ID NO: 11938 - protein, 212 aa, Homo sapiens
  Payload ID: 2360
  Gene Symbol: CEACAM3
  Gene Name: carcinoembryonic antigen-related cell adhesion molecule 3
  Uniprot ID: P40198
  ENSP ID: ENSP00000341725
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRPWSLPQLCLLDVPSLHCPGPPTQPQDSSFHL

SEQ ID NO: 11939 - protein, 252 aa, Homo sapiens
  Payload ID: 2360
  Gene Symbol: CEACAM3
  Gene Name: carcinoembryonic antigen-related cell adhesion molecule 3
  Uniprot ID: P40198
  ENSP ID: ENSP00000349971
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRTSIQRDLKEQQPQALAPGRGPSHSSAFSMSPLSTAQAPLPNPRTAASIYEELLKHDTNIYCRMDHKAEVAS

SEQ ID NO: 11940 - protein, 177 aa, Homo sapiens
  Payload ID: 2360
  Gene Symbol: CEACAM3
  Gene Name: carcinoembryonic antigen-related cell adhesion molecule 3
  Uniprot ID: P40198
  ENSP ID: ENSP00000411641
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYPELPKPSISSNNSNPKEDKDAVAFTCEPEIHSTTCL

SEQ ID NO: 11941 - protein, 99 aa, Homo sapiens
  Payload ID: 2360
  Gene Symbol: CEACAM3
  Gene Name: carcinoembryonic antigen-related cell adhesion molecule 3
  ENSP ID: ENSP00000469333
MPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFH

SEQ ID NO: 11942 - protein, 212 aa, Homo sapiens; identical to SEQ ID NO: 11938
  Payload ID: 2360
  Gene Symbol: CEACAM3
  Gene Name: carcinoembryonic antigen-related cell adhesion molecule 3
  Uniprot ID: P40198
  ENSP ID: ENSP00000485920

SEQ ID NO: 11943 - protein, 244 aa, Homo sapiens
  Payload ID: 2361
  Gene Symbol: CEACAM4
  Gene Name: carcinoembryonic antigen-related cell adhesion molecule 4
  Uniprot ID: O75871
  ENSP ID: ENSP00000221954
MGPPSAAPRGGHRPWQGLLITASLLTFWHPPTTVQFTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAGIVTGVLVGVALVAALVCFLLLSRTGRASIQRDLREQPPPASTPGHGPSHRSTFSAPLPSPRTATPIYEELLYSDANIYCQIDHKADVVS

SEQ ID NO: 11944 - protein, 254 aa, Homo sapiens
  Payload ID: 2361
  Gene Symbol: CEACAM4
  Gene Name: carcinoembryonic antigen-related cell adhesion molecule 4
  ENSP ID: ENSP00000473018
MGPPSAAPRGGHRPWQGLLITASLLTFWHPPTTVQFTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAGIVTGVLVGVALVAALVCFLLLSRTGSIQRDLREQPPPASTPGHGPSHRSTFSAPLPSPRTATPIYEVSVGHGCSGPAGSRGPRICPHQHLAELRFRKMQ

SEQ ID NO: 11945 - protein, 244 aa, Homo sapiens; identical to SEQ ID NO: 11943
  Payload ID: 2361
  Gene Symbol: CEACAM4
  Gene Name: carcinoembryonic antigen-related cell adhesion molecule 4
  Uniprot ID: O75871
  ENSP ID: ENSP00000481247

SEQ ID NO: 11946 - protein, 254 aa, Homo sapiens; identical to SEQ ID NO: 11944
  Payload ID: 2361
  Gene Symbol: CEACAM4
  Gene Name: carcinoembryonic antigen-related cell adhesion molecule 4
  ENSP ID: ENSP00000486872

SEQ ID NO: 11947 - protein, 702 aa, Homo sapiens
  Payload ID: 2362
  Gene Symbol: CEACAM5
  Gene Name: carcinoembryonic antigen-related cell adhesion molecule 5
  Uniprot ID: P06731
  ENSP ID: ENSP00000221992
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 11948 - protein, 701 aa, Homo sapiens
  Payload ID: 2362
  Gene Symbol: CEACAM5
  Gene Name: carcinoembryonic antigen-related cell adhesion molecule 5
  Uniprot ID: P06731
  ENSP ID: ENSP00000381600
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 11949 - protein, 702 aa, Homo sapiens; identical to SEQ ID NO: 11947
  Payload ID: 2362
  Gene Symbol: CEACAM5
  Gene Name: carcinoembryonic antigen-related cell adhesion molecule 5
  Uniprot ID: P06731
  ENSP ID: ENSP00000385072

SEQ ID NO: 11950 - protein, 141 aa, Homo sapiens
  Payload ID: 2362
  Gene Symbol: CEACAM5
  Gene Name: carcinoembryonic antigen-related cell adhesion molecule 5
  ENSP ID: ENSP00000468997
  MOD_RES (1)..(1): Any amino acid
XKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPEAQNT

SEQ ID NO: 11951 - protein, 194 aa, Homo sapiens
  Payload ID: 2362
  Gene Symbol: CEACAM5
  Gene Name: carcinoembryonic antigen-related cell adhesion molecule 5
  ENSP ID: ENSP00000473252
  MOD_RES (1)..(1): Any amino acid
XIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLSEPPKPFITSNNSNPVEDEDAVALTCEPEIQNTTYLWWVNNQSLPVSPRLQLSNDNRTL

SEQ ID NO: 11952 - protein, 346 aa, Homo sapiens
  Payload ID: 2362
  Gene Symbol: CEACAM5
  Gene Name: carcinoembryonic antigen-related cell adhesion molecule 5
  ENSP ID: ENSP00000480800
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 11953 - protein, 524 aa, Homo sapiens
  Payload ID: 2362
  Gene Symbol: CEACAM5
  Gene Name: carcinoembryonic antigen-related cell adhesion molecule 5
  ENSP ID: ENSP00000482157
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 11954 - protein, 702 aa, Homo sapiens; identical to SEQ ID NO: 11947
  Payload ID: 2362
  Gene Symbol: CEACAM5
  Gene Name: carcinoembryonic antigen-related cell adhesion molecule 5
  ENSP ID: ENSP00000482303

SEQ ID NO: 11955 - protein, 344 aa, Homo sapiens
  Payload ID: 2363
  Gene Symbol: CEACAM6
  Gene Name: carcinoembryonic antigen-related cell adhesion molecule 6 (non-specific cross reacting antigen)
  Uniprot ID: P40199
  ENSP ID: ENSP00000199764
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 11956 - protein, 33 aa, Homo sapiens
  Payload ID: 2363
  Gene Symbol: CEACAM6
  Gene Name: carcinoembryonic antigen-related cell adhesion molecule 6 (non-specific cross reacting antigen)
  ENSP ID: ENSP00000469752
MGPPSAPPCRLHVPWKEVLLTASLLTFWNPPTT

SEQ ID NO: 11957 - protein, 265 aa, Homo sapiens
  Payload ID: 2364
  Gene Symbol: CEACAM7
  Gene Name: carcinoembryonic antigen-related cell adhesion molecule 7
  Uniprot ID: Q14002
  ENSP ID: ENSP00000006724
MGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGIYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 11958 - protein, 265 aa, Homo sapiens; identical to SEQ ID NO: 11957
  Payload ID: 2364
  Gene Symbol: CEACAM7
  Gene Name: carcinoembryonic antigen-related cell adhesion molecule 7
  Uniprot ID: Q14002
  ENSP ID: ENSP00000385932

SEQ ID NO: 11959 - protein, 172 aa, Homo sapiens
  Payload ID: 2364
  Gene Symbol: CEACAM7
  Gene Name: carcinoembryonic antigen-related cell adhesion molecule 7
  ENSP ID: ENSP00000469597
MGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGIYTLHVIKENLVNEEVTRQFYVFYESVQASSPDLSAGTAVSIMIGVLAGMALI

SEQ ID NO: 11960 - protein, 30 aa, Homo sapiens
  Payload ID: 2364
  Gene Symbol: CEACAM7
  Gene Name: carcinoembryonic antigen-related cell adhesion molecule 7
  ENSP ID: ENSP00000486147
  MOD_RES (1)..(1): Any amino acid
XESVQASSPDLSAGTAVSIMIGVLAGMALI

SEQ ID NO: 11961 - protein, 30 aa, Homo sapiens; identical to SEQ ID NO: 11960
  Payload ID: 2364
  Gene Symbol: CEACAM7
  Gene Name: carcinoembryonic antigen-related cell adhesion molecule 7
  ENSP ID: ENSP00000486586
  MOD_RES (1)..(1): Any amino acid

SEQ ID NO: 11962 - protein, 30 aa, Homo sapiens; identical to SEQ ID NO: 11960
  Payload ID: 2364
  Gene Symbol: CEACAM7
  Gene Name: carcinoembryonic antigen-related cell adhesion molecule 7
  ENSP ID: ENSP00000487273
  MOD_RES (1)..(1): Any amino acid

SEQ ID NO: 11963 - protein, 349 aa, Homo sapiens
  Payload ID: 2365
  Gene Symbol: CEACAM8
  Gene Name: carcinoembryonic antigen-related cell adhesion molecule 8
  Uniprot ID: P31997
  ENSP ID: ENSP00000244336
MGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 11964 - protein, 51 aa, Homo sapiens
  Payload ID: 2365
  Gene Symbol: CEACAM8
  Gene Name: carcinoembryonic antigen-related cell adhesion molecule 8
  ENSP ID: ENSP00000472166
MGPISAPSCRWRIPWQGLLLTDALVQGSSPGLSARATVSIMIGVLARVALI

SEQ ID NO: 11965 - protein, 344 aa, Homo sapiens
  Payload ID: 2365
  Gene Symbol: CEACAM8
  Gene Name: carcinoembryonic antigen-related cell adhesion molecule 8
  ENSP ID: ENSP00000484915
MGPLSAPPCTQRITWKGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSGSSPGLSARATVSIMIGVLARVALI

SEQ ID NO: 11966 - protein, 301 aa, Homo sapiens
  Payload ID: 2366
  Gene Symbol: CRLS1
  Gene Name: cardiolipin synthase 1
  Uniprot ID: Q9UJA2
  ENSP ID: ENSP00000368140
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 11967 - protein, 202 aa, Homo sapiens
  Payload ID: 2366
  Gene Symbol: CRLS1
  Gene Name: cardiolipin synthase 1
  Uniprot ID: Q9UJA2
  ENSP ID: ENSP00000368145
MPQYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 11968 - protein, 205 aa, Homo sapiens
  Payload ID: 2366
  Gene Symbol: CRLS1
  Gene Name: cardiolipin synthase 1
  ENSP ID: ENSP00000416770
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPANTCQVFQSLLCHC

SEQ ID NO: 11969 - protein, 4069 aa, Homo sapiens
  Payload ID: 2367
  Gene Symbol: CMYA5
  Gene Name: cardiomyopathy associated 5
  Uniprot ID: Q8N3K9
  ENSP ID: ENSP00000394770
MASRDSNHAGESFLGSDGDEEATRELETEEESEGEEDETAAESEEEPDSRLSDQDEEGKIKQEYIISDPSFSMVTVQREDSGITWETNSSRSSTPWASEESQTSGVCSREGSTVNSPPGNVSFIVDEVKKVRKRTHKSKHGSPSLRRKGNRKRNSFESQDVPTNKKGSPLTSASQVLTTEKEKSYTGIYDKARKKKTTSNTPPITGAIYKEHKPLVLRPVYIGTVQYKIKMFNSVKEELIPLQFYGTLPKGYVIKEIHYRKGKDASISLEPDLDNSGSNTVSKTRKLVAQSIEDKVKEVFPPWRGALSKGSESLTLMFSHEDQKKIYADSPLNATSALEHTVPSYSSSGRAEQGIQLRHSQSVPQQPEDEAKPHEVEPPSVTPDTPATMFLRTTKEECELASPGTAASENDSSVSPSFANEVKKEDVYSAHHSISLEAASPGLAASTQDGLDPDQEQPDLTSIERAEPVSAKLTPTHPSVKGEKEENMLEPSISLSEPLMLEEPEKEEIETSLPIAITPEPEDSNLVEEEIVELDYPESPLVSEKPFPPHMSPEVEHKEEELILPLLAASSPEHVALSEEEREEIASVSTGSAFVSEYSVPQDLNHELQEQEGEPVPPSNVEAIAEHAVLSEEENEEFEAYSPAAAPTSESSLSPSTTEKTSENQSPLFSTVTPEYMVLSGDEASESGCYTPDSTSASEYSVPSLATKESLKKTIDRKSPLILKGVSEYMIPSEEKEDTGSFTPAVAPASEPSLSPSTTEKTSECQSPLPSTATSEHVVPSEGEDLGSERFTPDSKLISKYAAPLNATQESQKKIINEASQFKPKGISEHTVLSVDGKEVIGPSSPDLVVASEHSFPPHTTEMTSECQAPPLSATPSEYVVLSDEEAVELERYTPSSTSASEFSVPPYATPEAQEEEIVHRSLNLKGASSPMNLSEEDQEDIGPFSPDSAFVSEFSFPPYATQEAEKREFECDSPICLTSPSEHTILSDEDTEEAELFSPDSASQVSIPPFRISETEKNELEPDSLLTAVSASGYSCFSEADEEDIGSTAATPVSEQFSSSQKQKAETFPLMSPLEDLSLPPSTDKSEKAEIKPEIPTTSTSVSEYLILAQKQKTQAYLEPESEDLIPSHLTSEVEKGEREASSSVAAIPAALPAQSSIVKEETKPASPHSVLPDSVPAIKKEQEPTAALTLKAADEQMALSKVRKEEIVPDSQEATAHVSQDQKMEPQPPNVPESEMKYSVLPDMVDEPKKGVKPKLVLNVTSELEQRKLSKNEPEVIKPYSPLKETSLSGPEALSAVKMEMKHDSKITTTPIVLHSASSGVEKQVEHGPPALAFSALSEEIKKEIEPSSSTTTASVTKLDSNLTRAVKEEIPTDSSLITPVDRPVLTKVGKGELGSGLPPLVTSADEHSVLAEEDKVAIKGASPIETSSKHLAWSEAEKEIKFDSLPSVSSIAEHSVLSEVEAKEVKAGLPVIKTSSSQHSDKSEEARVEDKQDLLFSTVCDSERLVSSQKKSLMSTSEVLEPEHELPLSLWGEIKKKETELPSSQNVSPASKHIIPKGKDEETASSSPELENLASGLAPTLLLLSDDKNKPAVEVSSTAQGDFPSEKQDVALAELSLEPEKKDKPHQPLELPNAGSEFSSDLGRQSGSIGTKQAKSPITETEDSVLEKGPAELRSREGKEENRELCASSTMPAISELSSLLREESQNEEIKPFSPKIISLESKEPPASVAEGGNPEEFQPFTFSLKGLSEEVSHPADFKKGGNQEIGPLPPTGNLKAQVMGDILDKLSEETGHPNSSQVLQSITEPSKIAPSDLLVEQKKTEKALHSDQTVKLPDVSTSSEDKQDLGIKQFSLMRENLPLEQSKSFMTTKPADVKETKMEEFFISPKDENWMLGKPENVASQHEQRIAGSVQLDSSSSNELRPGQLKAAVSSKDHTCEVRKQVLPHSAEESHLSSQEAVSALDTSSGNTETLSSKSYSSEEVKLAEEPKSLVLAGNVERNIAEGKEIHSLMESESLLLEKANTELSWPSKEDSQEKIKLPPERFFQKPVSGLSVEQVKSETISSSVKTAHFPAEGVEPALGNEKEAHRSTPPFPEEKPLEESKMVQSKVIDDADEGKKPSPEVKIPTQRKPISSIHAREPQSPESPEVTQNPPTQPKVAKPDLPEEKGKKGISSFKSWMSSLFFGSSTPDNKVAEQEDLETQPSPSVEKAVTVIDPEGTIPTNFNVAEKPADHSLSEVKLKTADEPRGTLVKSGDGQNVKEKSMILSNVEDLQQPKFISEVSREDYGKKEISGDSEEMNINSVVTSADGENLEIQSYSLIGEKLVMEEAKTIVPPHVTDSKRVQKPAIAPPSKWNISIFKEEPRSDQKQKSLLSFDVVDKVPQQPKSASSNFASKNITKESEKPESIILPVEESKGSLIDFSEDRLKKEMQNPTSLKISEEETKLRSVSPTEKKDNLENRSYTLAEKKVLAEKQNSVAPLELRDSNEIGKTQITLGSRSTELKESKADAMPQHFYQNEDYNERPKIIVGSEKEKGEEKENQVYVLSEGKKQQEHQPYSVNVAESMSRESDISLGHSLGETQSFSLVKATSVTEKSEAMLAEAHPEIREAKAVGTQPHPLEESKVLVEKTKTFLPVALSCRDEIENHSLSQEGNLVLEKSSRDMPDHSEEKEQFRESELSKGGSVDITKETVKQGFQEKAVGTQPRPLEESKVLVEKTKTFLPVVLSCHDEIENHSLSQEGNLVLEKSSRDMPDHSEEKEQFKESELWKGGSVDITKESMKEGFPSKESERTLARPFDETKSSETPPYLLSPVKPQTLASGASPEINAVKKKEMPRSELTPERHTVHTIQTSKDDTSDVPKQSVLVSKHHLEAAEDTRVKEPLSSAKSNYAQFISNTSASNADKMVSNKEMPKEPEDTYAKGEDFTVTSKPAGLSEDQKTAFSIISEGCEILNIHAPAFISSIDQEESEQMQDKLEYLEEKASFKTIPLPDDSETVACHKTLKSRLEDEKVTPLKENKQKETHKTKEEISTDSETDLSFIQPTIPSEEDYFEKYTLIDYNISPDPEKQKAPQKLNVEEKLSKEVTEETISFPVSSVESALEHEYDLVKLDESFYGPEKGHNILSHPETQSQNSADRNVSKDTKRDVDSKSPGMPLFEAEEGVLSRTQIFPTTIKVIDPEFLEEPPALAFLYKDLYEEAVGEKKKEEETASEGDSVNSEASFPSRNSDTDDGTGIYFEKYILKDDILHDTSLTQKDQGQGLEEKRVGKDDSYQPIAAEGEIWGKFGTICREKSLEEQKGVYGEGESVDHVETVGNVAMQKKAPITEDVRVATQKISYAVPFEDTHHVLERADEAGSHGNEVGNASPEVNLNVPVQVSFPEEEFASGATHVQETSLEEPKILVPPEPSEERLRNSPVQDEYEFTESLHNEVVPQDILSEELSSESTPEDVLSQGKESFEHISENEFASEAEQSTPAEQKELGSERKEEDQLSSEVVTEKAQKELKKSQIDTYCYTCKCPISATDKVFGTHKDHEVSTLDTAISAVKVQLAEFLENLQEKSLRIEAFVSEIESFFNTIEENCSKNEKRLEEQNEEMMKKVLAQYDEKAQSFEEVKKKKMEFLHEQMVHFLQSMDTAKDTLETIVREAEELDEAVFLTSFEEINERLLSAMESTASLEKMPAAFSLFEHYDDSSARSDQMLKQVAVPQPPRLEPQEPNSATSTTIAVYWSMNKEDVIDSFQVYCMEEPQDDQEVNELVEEYRLTVKESYCIFEDLEPDRCYQVWVMAVNFTGCSLPSERAIFRTAPSTPVIRAEDCTVCWNTATIRWRPTTPEATETYTLEYCRQHSPEGEGLRSFSGIKGLQLKVNLQPNDNYFFYVRAINAFGTSEQSEAALISTRGTRFLLLRETAHPALHISSSGTVISFGERRRLTEIPSVLGEELPSCGQHYWETTVTDCPAYRLGICSSSAVQAGALGQGETSWYMHCSEPQRYTFFYSGIVSDVHVTERPARVGILLDYNNQRLIFINAESEQLLFIIRHRFNEGVHPAFALEKPGKCTLHLGIEPPDSVRHK

SEQ ID NO: 11970 - protein, 201 aa, Homo sapiens
  Payload ID: 2368
  Gene Symbol: CTF1
  Gene Name: cardiotrophin 1
  Uniprot ID: Q16619
  ENSP ID: ENSP00000279804
MSRREGSLEDPQTDSSVSLLPHLEAKIRQTHSLAHLLTKYAEQLLQEYVQLQGDPFGLPSFSPPRLPVAGLSAPAPSHAGLPVHERLRLDAAALAALPPLLDAVCRRQAELNPRAPRLLRRLEDAARQARALGAAVEALLAALGAANRGPRAEPPAATASAASATGVFPAKVLGLRVCGLYREWLSRTEGDLGQLLPGGSA

SEQ ID NO: 11971 - protein, 200 aa, Homo sapiens
  Payload ID: 2368
  Gene Symbol: CTF1
  Gene Name: cardiotrophin 1
  Uniprot ID: Q16619
  ENSP ID: ENSP00000378465
MSRREGSLDPQTDSSVSLLPHLEAKIRQTHSLAHLLTKYAEQLLQEYVQLQGDPFGLPSFSPPRLPVAGLSAPAPSHAGLPVHERLRLDAAALAALPPLLDAVCRRQAELNPRAPRLLRRLEDAARQARALGAAVEALLAALGAANRGPRAEPPAATASAASATGVFPAKVLGLRVCGLYREWLSRTEGDLGQLLPGGSA

SEQ ID NO: 11972 - protein, 225 aa, Homo sapiens
  Payload ID: 2369
  Gene Symbol: CLCF1
  Gene Name: cardiotrophin-like cytokine  factor 1
  Uniprot ID: Q9UBD9
  ENSP ID: ENSP00000309338
MDLRAGDSWGMLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 11973 - protein, 215 aa, Homo sapiens
  Payload ID: 2369
  Gene Symbol: CLCF1
  Gene Name: cardiotrophin-like cytokine  factor 1
  Uniprot ID: Q9UBD9
  ENSP ID: ENSP00000434122
MLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 11974 - protein, 626 aa, Homo sapiens
  Payload ID: 2370
  Gene Symbol: CRAT
  Gene Name: carnitine O-acetyltransferase
  Uniprot ID: P43155
  ENSP ID: ENSP00000315013
MLAFAARTVVKPLGFLKPFSLMKASSRFKAHQDALPRLPVPPLQQSLDHYLKALQPIVSEEEWAHTKQLVDEFQASGGVGERLQKGLERRARKTENWLSEWWLKTAYLQYRQPVVIYSSPGVMLPKQDFVDLQGQLRFAAKLIEGVLDFKVMIDNETLPVEYLGGKPLCMNQYYQILSSCRVPGPKQDTVSNFSKTKKPPTHITVVHNYQFFELDVYHSDGTPLTADQIFVQLEKIWNSSLQTNKEPVGILTSNHRNSWAKAYNTLIKDKVNRDSVRSIQKSIFTVCLDATMPRVSEDVYRSHVAGQMLHGGGSRLNSGNRWFDKTLQFIVAEDGSCGLVYEHAAAEGPPIVTLLDYVIEYTKKPELVRSPLVPLPMPKKLRFNITPEIKSDIEKAKQNLSIMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVSMPDIFMDTSYAIAMHFHLSTSQVPAKTDCVMFFGPVVPDGYGVCYNPMEAHINFSLSAYNSCAETNAARLAHYLEKALLDMRALLQSHPRAKL

SEQ ID NO: 11975 - protein, 161 aa, Homo sapiens
  Payload ID: 2370
  Gene Symbol: CRAT
  Gene Name: carnitine O-acetyltransferase
  ENSP ID: ENSP00000377045
MLAFAARTVVKPLGFLKPFSLMKASSRFKAHQDALPRLPVPPLQQSLDHYLKALQPIVSEEEWAHTKQLVDEFQASGGVGERLQKGLERRARKTENWVSEGILTVTCCWLHMHSSPVPTALARPFVCCPEFREHILCVWHLAGCWVIKKDTVTSSLELTFK

SEQ ID NO: 11976 - protein, 98 aa, Homo sapiens
  Payload ID: 2370
  Gene Symbol: CRAT
  Gene Name: carnitine O-acetyltransferase
  ENSP ID: ENSP00000390571
MEEDGQQREKVKPLGFLKPFSLMKASSRFKAHQDALPRLPVPPLQQSLDHYLKALQPIVSEEEWAHTKQLVDEFQASGGVGERLQKGLERRARKTENW

SEQ ID NO: 11977 - protein, 31 aa, Homo sapiens
  Payload ID: 2370
  Gene Symbol: CRAT
  Gene Name: carnitine O-acetyltransferase
  ENSP ID: ENSP00000394420
  MOD_RES (1)..(1): Any amino acid
XRSQGCGVTSAARQSLSSSQVFPHQNDLRRF

SEQ ID NO: 11978 - protein, 201 aa, Homo sapiens
  Payload ID: 2370
  Gene Symbol: CRAT
  Gene Name: carnitine O-acetyltransferase
  ENSP ID: ENSP00000395458
  MOD_RES (1)..(1): Any amino acid
XMIQDLDITVMVFHHFGKDFPKSEKLSPDAFIQMALQLAYYRIYGQACATYESASLRMFHLGRTDTIRSASMDSLTFVKAMDDSSVTEHQKVELLRKAVQAHRGYTDRAIRGEAFDRHLLGLKLQAIEDLVPAKTDCVMFFGPVVPDGYGVCYNPMEAHINFSLSAYNSCAETNAARLAHYLEKALLDMRALLQSHPRAKL

SEQ ID NO: 11979 - protein, 40 aa, Homo sapiens
  Payload ID: 2370
  Gene Symbol: CRAT
  Gene Name: carnitine O-acetyltransferase
  ENSP ID: ENSP00000400367
MLAFAARTVDRSQGCGVTSAARQSLSSSQVFPHQNDLRRF

SEQ ID NO: 11980 - protein, 40 aa, Homo sapiens; identical to SEQ ID NO: 11979
  Payload ID: 2370
  Gene Symbol: CRAT
  Gene Name: carnitine O-acetyltransferase
  ENSP ID: ENSP00000404405

SEQ ID NO: 11981 - protein, 612 aa, Homo sapiens
  Payload ID: 2371
  Gene Symbol: CROT
  Gene Name: carnitine O-octanoyltransferase
  Uniprot ID: Q9UKG9
  ENSP ID: ENSP00000331981
MENQLAKSTEERTFQYQDSLPSLPVPSLEESLKKYLESVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRFVVACSAWKSCPETDAEKLVQLTFCAFHDMIQLMNSTHL

SEQ ID NO: 11982 - protein, 87 aa, Homo sapiens
  Payload ID: 2371
  Gene Symbol: CROT
  Gene Name: carnitine O-octanoyltransferase
  Uniprot ID: Q9UKG9
  ENSP ID: ENSP00000404867
MENQLAKSTEERTFQYQDSLPSLPVPSLEESLKKYLESVKPFANQEEYKKTEEIVQKFQSGIGEKLHQKLLERAKGKRNWVFVVIIE

SEQ ID NO: 11983 - protein, 574 aa, Homo sapiens
  Payload ID: 2371
  Gene Symbol: CROT
  Gene Name: carnitine O-octanoyltransferase
  ENSP ID: ENSP00000411983
MENQLAKSTEERTFQYQDSLPSLPVPSLEESLKKYLESVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRC

SEQ ID NO: 11984 - protein, 640 aa, Homo sapiens
  Payload ID: 2371
  Gene Symbol: CROT
  Gene Name: carnitine O-octanoyltransferase
  Uniprot ID: Q9UKG9
  ENSP ID: ENSP00000413575
MENQLAKSTEERTFQYQDSLPSLPVPSLEESLKKYLESVTRTCYQIRGLDPDAKRGFLDLTREGIQVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRFVVACSAWKSCPETDAEKLVQLTFCAFHDMIQLMNSTHL

SEQ ID NO: 11985 - protein, 773 aa, Homo sapiens
  Payload ID: 2372
  Gene Symbol: CPT1A
  Gene Name: carnitine palmitoyltransferase 1A (liver)
  Uniprot ID: P50416
  ENSP ID: ENSP00000265641
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 11986 - protein, 756 aa, Homo sapiens
  Payload ID: 2372
  Gene Symbol: CPT1A
  Gene Name: carnitine palmitoyltransferase 1A (liver)
  Uniprot ID: P50416
  ENSP ID: ENSP00000365803
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETGIISQGPSSDT

SEQ ID NO: 11987 - protein, 756 aa, Homo sapiens; identical to SEQ ID NO: 11986
  Payload ID: 2372
  Gene Symbol: CPT1A
  Gene Name: carnitine palmitoyltransferase 1A (liver)
  Uniprot ID: P50416
  ENSP ID: ENSP00000439084

SEQ ID NO: 11988 - protein, 773 aa, Homo sapiens; identical to SEQ ID NO: 11985
  Payload ID: 2372
  Gene Symbol: CPT1A
  Gene Name: carnitine palmitoyltransferase 1A (liver)
  Uniprot ID: P50416
  ENSP ID: ENSP00000446108

SEQ ID NO: 11989 - protein, 78 aa, Homo sapiens
  Payload ID: 2372
  Gene Symbol: CPT1A
  Gene Name: carnitine palmitoyltransferase 1A (liver)
  ENSP ID: ENSP00000454332
MVNSNYYAMDLLYILPTHIQAARAGNAIHAILLYRRKLDREEIKPIRLLGSTIPLCSAQWERMFNTSRIPGEETDDLP

SEQ ID NO: 11990 - protein, 117 aa, Homo sapiens
  Payload ID: 2372
  Gene Symbol: CPT1A
  Gene Name: carnitine palmitoyltransferase 1A (liver)
  ENSP ID: ENSP00000455116
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVA

SEQ ID NO: 11991 - protein, 93 aa, Homo sapiens
  Payload ID: 2372
  Gene Symbol: CPT1A
  Gene Name: carnitine palmitoyltransferase 1A (liver)
  ENSP ID: ENSP00000457663
MAEAHQAVAFQFTVTPDGIDLRLSHEALRQIYLSGLHSWKKKFIRFKNGIITGVYPASPSSWLIVVVGVMTTMYAKIDPSLGIIAKINRTLET

SEQ ID NO: 11992 - protein, 134 aa, Homo sapiens
  Payload ID: 2372
  Gene Symbol: CPT1A
  Gene Name: carnitine palmitoyltransferase 1A (liver)
  ENSP ID: ENSP00000457826
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHG

SEQ ID NO: 11993 - protein, 772 aa, Homo sapiens
  Payload ID: 2373
  Gene Symbol: CPT1B
  Gene Name: carnitine palmitoyltransferase 1B (muscle)
  Uniprot ID: Q92523
  ENSP ID: ENSP00000312189
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 11994 - protein, 772 aa, Homo sapiens; identical to SEQ ID NO: 11993
  Payload ID: 2373
  Gene Symbol: CPT1B
  Gene Name: carnitine palmitoyltransferase 1B (muscle)
  Uniprot ID: Q92523
  ENSP ID: ENSP00000353945

SEQ ID NO: 11995 - protein, 772 aa, Homo sapiens; identical to SEQ ID NO: 11993
  Payload ID: 2373
  Gene Symbol: CPT1B
  Gene Name: carnitine palmitoyltransferase 1B (muscle)
  Uniprot ID: Q92523
  ENSP ID: ENSP00000379011

SEQ ID NO: 11996 - protein, 772 aa, Homo sapiens; identical to SEQ ID NO: 11993
  Payload ID: 2373
  Gene Symbol: CPT1B
  Gene Name: carnitine palmitoyltransferase 1B (muscle)
  Uniprot ID: Q92523
  ENSP ID: ENSP00000385486

SEQ ID NO: 11997 - protein, 92 aa, Homo sapiens
  Payload ID: 2373
  Gene Symbol: CPT1B
  Gene Name: carnitine palmitoyltransferase 1B (muscle)
  ENSP ID: ENSP00000396408
LMVNSNYYVMDLVLIKNTDVQAARLGNIIHAMIMYRRKLDREEIKPVMALGIVPMCSYQMERMFNTTRIPGKDTGLLVLREREWKHPAQGLV

SEQ ID NO: 11998 - protein, 125 aa, Homo sapiens
  Payload ID: 2373
  Gene Symbol: CPT1B
  Gene Name: carnitine palmitoyltransferase 1B (muscle)
  ENSP ID: ENSP00000406316
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFR

SEQ ID NO: 11999 - protein, 738 aa, Homo sapiens
  Payload ID: 2373
  Gene Symbol: CPT1B
  Gene Name: carnitine palmitoyltransferase 1B (muscle)
  Uniprot ID: Q92523
  ENSP ID: ENSP00000409342
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 12000 - protein, 803 aa, Homo sapiens
  Payload ID: 2374
  Gene Symbol: CPT1C
  Gene Name: carnitine palmitoyltransferase 1C
  Uniprot ID: Q8TCG5
  ENSP ID: ENSP00000319343
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 12001 - protein, 803 aa, Homo sapiens; identical to SEQ ID NO: 12000
  Payload ID: 2374
  Gene Symbol: CPT1C
  Gene Name: carnitine palmitoyltransferase 1C
  Uniprot ID: Q8TCG5
  ENSP ID: ENSP00000376303

SEQ ID NO: 12002 - protein, 792 aa, Homo sapiens
  Payload ID: 2374
  Gene Symbol: CPT1C
  Gene Name: carnitine palmitoyltransferase 1C
  Uniprot ID: Q8TCG5
  ENSP ID: ENSP00000384465
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 12003 - protein, 257 aa, Homo sapiens
  Payload ID: 2374
  Gene Symbol: CPT1C
  Gene Name: carnitine palmitoyltransferase 1C
  ENSP ID: ENSP00000470221
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMM

SEQ ID NO: 12004 - protein, 68 aa, Homo sapiens
  Payload ID: 2374
  Gene Symbol: CPT1C
  Gene Name: carnitine palmitoyltransferase 1C
  ENSP ID: ENSP00000470739
MAEAHQAVGFRPSLTSDGAEVELSAPVLQEIYLSGLRSWKRHLSRFWGLTYFVTQAGVQCHHHSSLHP

SEQ ID NO: 12005 - protein, 68 aa, Homo sapiens; identical to SEQ ID NO: 12004
  Payload ID: 2374
  Gene Symbol: CPT1C
  Gene Name: carnitine palmitoyltransferase 1C
  ENSP ID: ENSP00000471160

SEQ ID NO: 12006 - protein, 177 aa, Homo sapiens
  Payload ID: 2374
  Gene Symbol: CPT1C
  Gene Name: carnitine palmitoyltransferase 1C
  ENSP ID: ENSP00000471579
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVP

SEQ ID NO: 12007 - protein, 81 aa, Homo sapiens
  Payload ID: 2374
  Gene Symbol: CPT1C
  Gene Name: carnitine palmitoyltransferase 1C
  ENSP ID: ENSP00000471841
VSYIFMGDGMITFHISSKKSSTKTDSHRLGQHIEDALLDVASLFQAGQHFKRRFRGSGKENSRHSRQLASPRNKGEIATAG

SEQ ID NO: 12008 - protein, 130 aa, Homo sapiens
  Payload ID: 2374
  Gene Symbol: CPT1C
  Gene Name: carnitine palmitoyltransferase 1C
  ENSP ID: ENSP00000472453
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWPWSASSLAATRCCSVTSAPCHASPCPLCRTPCASTW

SEQ ID NO: 12009 - protein, 336 aa, Homo sapiens
  Payload ID: 2374
  Gene Symbol: CPT1C
  Gene Name: carnitine palmitoyltransferase 1C
  ENSP ID: ENSP00000472579
LAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 12010 - protein, 68 aa, Homo sapiens; identical to SEQ ID NO: 12004
  Payload ID: 2374
  Gene Symbol: CPT1C
  Gene Name: carnitine palmitoyltransferase 1C
  ENSP ID: ENSP00000472742

SEQ ID NO: 12011 - protein, 95 aa, Homo sapiens
  Payload ID: 2374
  Gene Symbol: CPT1C
  Gene Name: carnitine palmitoyltransferase 1C
  ENSP ID: ENSP00000472828
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWG

SEQ ID NO: 12012 - protein, 803 aa, Homo sapiens; identical to SEQ ID NO: 12000
  Payload ID: 2374
  Gene Symbol: CPT1C
  Gene Name: carnitine palmitoyltransferase 1C
  Uniprot ID: Q8TCG5
  ENSP ID: ENSP00000473028

SEQ ID NO: 12013 - protein, 72 aa, Homo sapiens
  Payload ID: 2374
  Gene Symbol: CPT1C
  Gene Name: carnitine palmitoyltransferase 1C
  ENSP ID: ENSP00000473082
MAEAHQAVGFRPSLTSDGAEVELSAPVLQEIYLSGLRSWKRHLSRFWCHPACLVPPAGSFLRTDGEDQRVAA

SEQ ID NO: 12014 - protein, 658 aa, Homo sapiens
  Payload ID: 2375
  Gene Symbol: CPT2
  Gene Name: carnitine palmitoyltransferase 2
  Uniprot ID: P23786
  ENSP ID: ENSP00000360541
MVPRLLLRAWPRGPAVGPGAPSRPLSAGSGPGQYLQRSIVPTMHYQDSLPRLPIPKLEDTIRRYLSAQKPLLNDGQFRKTEQFCKSFENGIGKELHEQLVALDKQNKHTSYISGPWFDMYLSARDSVVLNFNPFMAFNPDPKSEYNDQLTRATNMTVSAIRFLKTLRAGLLEPEVFHLNPAKSDTITFKRLIRFVPSSLSWYGAYLVNAYPLDMSQYFRLFNSTRLPKPSRDELFTDDKARHLLVLRKGNFYIFDVLDQDGNIVSPSEIQAHLKYILSDSSPAPEFPLAYLTSENRDIWAELRQKLMSSGNEESLRKVDSAVFCLCLDDFPIKDLVHLSHNMLHGDGTNRWFDKSFNLIIAKDGSTAVHFEHSWGDGVAVLRFFNEVFKDSTQTPAVTPQSQPATTDSTVTVQKLNFELTDALKTGITAAKEKFDATMKTLTIDCVQFQRGGKEFLKKQKLSPDAVAQLAFQMAFLRQYGQTVATYESCSTAAFKHGRTETIRPASVYTKRCSEAFVREPSRHSAGELQQMMVECSKYHGQLTKEAAMGQGFDRHLFALRHLAAAKGIILPELYLDPAYGQINHNVLSTSTLSSPAVNLGGFAPVVSDGFGVGYAVHDNWIGCNVSSYPGRNAREFLQCVEKALEDMFDALEGKSIKS

SEQ ID NO: 12015 - protein, 507 aa, Homo sapiens
  Payload ID: 2376
  Gene Symbol: CNDP1
  Gene Name: carnosine dipeptidase 1 (metallopeptidase M20 family)
  Uniprot ID: Q96KN2
  ENSP ID: ENSP00000351682
MDPKLGRMAASLLAVLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 12016 - protein, 464 aa, Homo sapiens
  Payload ID: 2376
  Gene Symbol: CNDP1
  Gene Name: carnosine dipeptidase 1 (metallopeptidase M20 family)
  ENSP ID: ENSP00000462096
MDPKLGRMTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 12017 - protein, 38 aa, Homo sapiens
  Payload ID: 2376
  Gene Symbol: CNDP1
  Gene Name: carnosine dipeptidase 1 (metallopeptidase M20 family)
  ENSP ID: ENSP00000463807
  MOD_RES (1)..(1): Any amino acid
XADRGDGWLTDPYVLTEGNFMDEERPTTKALSWLGSML

SEQ ID NO: 12018 - protein, 153 aa, Homo sapiens
  Payload ID: 2377
  Gene Symbol: CARNMT1
  Gene Name: carnosine N-methyltransferase 1
  ENSP ID: ENSP00000366026
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDVCESLFYFCLF

SEQ ID NO: 12019 - protein, 409 aa, Homo sapiens
  Payload ID: 2377
  Gene Symbol: CARNMT1
  Gene Name: carnosine N-methyltransferase 1
  Uniprot ID: Q8N4J0
  ENSP ID: ENSP00000366030
MQRRRRPPPPTSRLPEGCGGGGGGSEEVEVQFSAGRWGSAAAVSAAAAAATRSTEEEEERLEREHFWKIINAFRYYGTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEIYSECNTWDCIATCFFIDTAHNVIDYIDTIWKILKPGGIWINLGPLLYHFENLANELSIELSYEDIKNVVLQYGFKVEVEKESVLSTYTVNDLSMMKYYYECVLFVVRKPQ

SEQ ID NO: 12020 - protein, 238 aa, Homo sapiens
  Payload ID: 2377
  Gene Symbol: CARNMT1
  Gene Name: carnosine N-methyltransferase 1
  ENSP ID: ENSP00000396353
VLRLQLESDRHDLLRSTSMHERVNRTERQFRSLPANQQKLLPQFLLHLDKIRKCIDHNQEILLTIVNDCIHMFENKEYGEDGNGKIMPASTFDMDKLKSTLKQFVRDWSETGKAERDACYQPIIKEILKNFPKERWDPSKVNILVPGAGLGRLAWEIAMLGYACQGNEWSFFMLFSSNFVLNRCSEINKYKLYPWIHQFSNNRRSADQIRPIFFPDVDPHSLPPGSNFSMTAGDFQEI

SEQ ID NO: 12021 - protein, 827 aa, Homo sapiens
  Payload ID: 2378
  Gene Symbol: CARNS1
  Gene Name: carnosine synthase 1
  Uniprot ID: A5YM72
  ENSP ID: ENSP00000308268
MLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 12022 - protein, 950 aa, Homo sapiens
  Payload ID: 2378
  Gene Symbol: CARNS1
  Gene Name: carnosine synthase 1
  Uniprot ID: A5YM72
  ENSP ID: ENSP00000389009
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 12023 - protein, 924 aa, Homo sapiens
  Payload ID: 2378
  Gene Symbol: CARNS1
  Gene Name: carnosine synthase 1
  Uniprot ID: A5YM72
  ENSP ID: ENSP00000431670
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 12024 - protein, 116 aa, Homo sapiens
  Payload ID: 2379
  Gene Symbol: CARTPT
  Gene Name: CART prepropeptide
  Uniprot ID: Q16568
  ENSP ID: ENSP00000296777
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 12025 - protein, 637 aa, Homo sapiens
  Payload ID: 2380
  Gene Symbol: CRTAC1
  Gene Name: cartilage acidic protein 1
  ENSP ID: ENSP00000310810
MSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 12026 - protein, 645 aa, Homo sapiens
  Payload ID: 2380
  Gene Symbol: CRTAC1
  Gene Name: cartilage acidic protein 1
  Uniprot ID: Q9NQ79
  ENSP ID: ENSP00000359623
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 12027 - protein, 661 aa, Homo sapiens
  Payload ID: 2380
  Gene Symbol: CRTAC1
  Gene Name: cartilage acidic protein 1
  Uniprot ID: Q9NQ79
  ENSP ID: ENSP00000359629
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 12028 - protein, 79 aa, Homo sapiens
  Payload ID: 2380
  Gene Symbol: CRTAC1
  Gene Name: cartilage acidic protein 1
  ENSP ID: ENSP00000404549
  MOD_RES (1)..(1): Any amino acid
XDEDTLQDPAPLETPMNASSSHSCALETSPYVSTPMEATGAGPTRSAVGATSPTRMAQPAWKEPCYLVSAISLENRMLL

SEQ ID NO: 12029 - protein, 524 aa, Homo sapiens
  Payload ID: 2380
  Gene Symbol: CRTAC1
  Gene Name: cartilage acidic protein 1
  ENSP ID: ENSP00000408445
YALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWGLSASHRAPAPPPPPLLLPLPLLLPLLELPLLHRSS

SEQ ID NO: 12030 - protein, 401 aa, Homo sapiens
  Payload ID: 2381
  Gene Symbol: CRTAP
  Gene Name: cartilage associated protein
  Uniprot ID: O75718
  ENSP ID: ENSP00000323696
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIADHYVEVLECKIQCEENLTPVIGGYPVEKFVATMYHYLQFAYYKLNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 12031 - protein, 358 aa, Homo sapiens
  Payload ID: 2381
  Gene Symbol: CRTAP
  Gene Name: cartilage associated protein
  ENSP ID: ENSP00000409997
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIAVNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 12032 - protein, 1156 aa, Homo sapiens
  Payload ID: 2382
  Gene Symbol: CILP2
  Gene Name: cartilage intermediate layer protein 2
  Uniprot ID: Q8IUL8
  ENSP ID: ENSP00000291495
MASLLPLLCLCVVAAHLAGARDATPTEEPMATALGLERRSVYTGQPSPALEDWEEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCPGCSLDTCECPDHILLGSVVTPSGQPLLGARVSLRDQPGTVATSDAHGTFRVPGVCADSRANIRAQMDGFSAGEAQAQANGSISVVTIILDKLEKPYLVKHPESRVREAGQNVTFCCKASGTPMPKKYSWFHNGTLLDRRAHGYGAHLELRGLRPDQAGIYHCKAWNEAGAVRSGTARLTVLAPGQPACDPRPREYLIKLPEDCGQPGSGPAYLDVGLCPDTRCPSLAGSSPRCGDASSRCCSVRRLERREIHCPGYVLPVKVVAECGCQKCLPPRGLVRGRVVAADSGEPLRFARILLGQEPIGFTAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRRCFVKVRAYANDKFTPSEQVEGVVVTLVNLEPAPGFSANPRAWGRFDSAVTGPNGACLPAFCDADRPDAYTALVTATLGGEELEPAPSLPRPLPATVGVTQPYLDRLGYRRTDHDDPAFKRNGFRINLAKPRPGDPAEANGPVYPWRSLRECQGAPVTASHFRFARVEADKYEYNVVPFREGTPASWTGDLLAWWPNPQEFRACFLKVKIQGPQEYMVRSHNAGGSHPRTRGQLYGLRDARSVRDPERPGTSAACVEFKCSGMLFDQRQVDRTLVTIMPQGSCRRVAVNGLLRDYLTRHPPPVPAEDPAAFSMLAPLDPLGHNYGVYTVTDQSPRLAKEIAIGRCFDGSSDGFSREMKADAGTAVTFQCREPPAGRPSLFQRLLESPATALGDIRREMSEAAQAQARASGPLRTRRGRVRQ

SEQ ID NO: 12033 - protein, 1162 aa, Homo sapiens
  Payload ID: 2382
  Gene Symbol: CILP2
  Gene Name: cartilage intermediate layer protein 2
  ENSP ID: ENSP00000467413
MASLLPLLCLCVVAAHLAGARDATPTEEPMATALGLERRSVYTGQPSPALEDWEARAVPAEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCPGCSLDTCECPDHILLGSVVTPSGQPLLGARVSLRDQPGTVATSDAHGTFRVPGVCADSRANIRAQMDGFSAGEAQAQANGSISVVTIILDKLEKPYLVKHPESRVREAGQNVTFCCKASGTPMPKKYSWFHNGTLLDRRAHGYGAHLELRGLRPDQAGIYHCKAWNEAGAVRSGTARLTVLAPGQPACDPRPREYLIKLPEDCGQPGSGPAYLDVGLCPDTRCPSLAGSSPRCGDASSRCCSVRRLERREIHCPGYVLPVKVVAECGCQKCLPPRGLVRGRVVAADSGEPLRFARILLGQEPIGFTAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRRCFVKVRAYANDKFTPSEQVEGVVVTLVNLEPAPGFSANPRAWGRFDSAVTGPNGACLPAFCDADRPDAYTALVTATLGGEELEPAPSLPRPLPATVGVTQPYLDRLGYRRTDHDDPAFKRNGFRINLAKPRPGDPAEANGPVYPWRSLRECQGAPVTASHFRFARVEADKYEYNVVPFREGTPASWTGDLLAWWPNPQEFRACFLKVKIQGPQEYMVRSHNAGGSHPRTRGQLYGLRDARSVRDPERPGTSAACVEFKCSGMLFDQRQVDRTLVTIMPQGSCRRVAVNGLLRDYLTRHPPPVPAEDPAAFSMLAPLDPLGHNYGVYTVTDQSPRLAKEIAIGRCFDGSSDGFSREMKADAGTAVTFQCREPPAGRPSLFQRLLESPATALGDIRREMSEAAQAQARASGPLRTRRGRVRQ

SEQ ID NO: 12034 - protein, 1184 aa, Homo sapiens
  Payload ID: 2383
  Gene Symbol: CILP
  Gene Name: cartilage intermediate layer protein, nucleotide pyrophosphohydrolase
  Uniprot ID: O75339
  ENSP ID: ENSP00000261883
MVGTKAWVFSFLVLEVTSVLGRQTMLTQSVRRVQPGKKNPSIFAKPADTLESPGEWTTWFNIDYPGGKGDYERLDAIRFYYGDRVCARPLRLEARTTDWTPAGSTGQVVHGSPREGFWCLNREQRPGQNCSNYTVRFLCPPGSLRRDTERIWSPWSPWSKCSAACGQTGVQTRTRICLAEMVSLCSEASEEGQHCMGQDCTACDLTCPMGQVNADCDACMCQDFMLHGAVSLPGGAPASGAAIYLLTKTPKLLTQTDSDGRFRIPGLCPDGKSILKITKVKFAPIVLTMPKTSLKAATIKAEFVRAETPYMVMNPETKARRAGQSVSLCCKATGKPRPDKYFWYHNDTLLDPSLYKHESKLVLRKLQQHQAGEYFCKAQSDAGAVKSKVAQLIVIASDETPCNPVPESYLIRLPHDCFQNATNSFYYDVGRCPVKTCAGQQDNGIRCRDAVQNCCGISKTEEREIQCSGYTLPTKVAKECSCQRCTETRSIVRGRVSAADNGEPMRFGHVYMGNSRVSMTGYKGTFTLHVPQDTERLVLTFVDRLQKFVNTTKVLPFNKKGSAVFHEIKMLRRKKPITLEAMETNIIPLGEVVGEDPMAELEIPSRSFYRQNGEPYIGKVKASVTFLDPRNISTATAAQTDLNFINDEGDTFPLRTYGMFSVDFRDEVTSEPLNAGKVKVHLDSTQVKMPEHISTVKLWSLNPDTGLWEEEGDFKFENQRRNKREDRTFLVGNLEIRERRLFNLDVPESRRCFVKVRAYRSERFLPSEQIQGVVISVINLEPRTGFLSNPRAWGRFDSVITGPNGACVPAFCDDQSPDAYSAYVLASLAGEELQAVESSPKFNPNAIGVPQPYLNKLNYRRTDHEDPRVKKTAFQISMAKPRPNSAEESNGPIYAFENLRACEEAPPSAAHFRFYQIEGDRYDYNTVPFNEDDPMSWTEDYLAWWPKPMEFRACYIKVKIVGPLEVNVRSRNMGGTHRQTVGKLYGIRDVRSTRDRDQPNVSAACLEFKCSGMLYDQDRVDRTLVKVIPQGSCRRASVNPMLHEYLVNHLPLAVNNDTSEYTMLAPLDPLGHNYGIYTVTDQDPRTAKEIALGRCFDGTSDGSSRIMKSNVGVALTFNCVERQVGRQSAFQYLQSTPAQSPAAGTVQGRVPSRRQQRASRGGQRQGGVVASLRFPRVAQQPLIN

SEQ ID NO: 12035 - protein, 757 aa, Homo sapiens
  Payload ID: 2384
  Gene Symbol: COMP
  Gene Name: cartilage oligomeric matrix protein
  Uniprot ID: P49747
  ENSP ID: ENSP00000222271
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 12036 - protein, 704 aa, Homo sapiens
  Payload ID: 2384
  Gene Symbol: COMP
  Gene Name: cartilage oligomeric matrix protein
  Uniprot ID: P49747
  ENSP ID: ENSP00000403792
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 12037 - protein, 724 aa, Homo sapiens
  Payload ID: 2384
  Gene Symbol: COMP
  Gene Name: cartilage oligomeric matrix protein
  ENSP ID: ENSP00000439156
MLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 12038 - protein, 786 aa, Homo sapiens
  Payload ID: 2385
  Gene Symbol: CASS4
  Gene Name: Cas scaffolding protein family member 4
  Uniprot ID: Q9NQ75
  ENSP ID: ENSP00000353462
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASGQGVPLISVTTLRRGGYSTLPNPQKSEWIYDTPVSPGKASVRNTPLTSFAEESRPHALPSSSSTFYNPPSGRSRSLTPQLNNNVPMQKKLSLPEIPSYGFLVPRGTFPLDEDVSYKVPSSFLIPRVEQQNTKPNIYDIPKATSSVSQAGKELEKAKEVSENSAGHNSSWFSRRTTSPSPEPDRLSGSSSDSRASIVSSCSTTSTDDSSSSSSEESAKELSLDLDVAKETVMALQHKVVSSVAGLMLFVSRKWRFRDYLEANIDAIHRSTDHIEESVREFLDFARGVHGTACNLTDSNLQNRIRDQMQTISNSYRILLETKESLDNRNWPLEVLVTDSVQNSPDDLERFVMVARMLPEDIKRFASIVIANGRLLFKRNCEKEETVQLTPNAEFKCEKYIQPPQRETESHQKSTPSTKQREDEHSSELLKKNRANICGQNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 12039 - protein, 349 aa, Homo sapiens
  Payload ID: 2385
  Gene Symbol: CASS4
  Gene Name: Cas scaffolding protein family member 4
  Uniprot ID: Q9NQ75
  ENSP ID: ENSP00000410027
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 12040 - protein, 797 aa, Homo sapiens
  Payload ID: 2386
  Gene Symbol: CASD1
  Gene Name: CAS1 domain containing 1
  Uniprot ID: Q96PB1
  ENSP ID: ENSP00000297273
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 12041 - protein, 45 aa, Homo sapiens
  Payload ID: 2386
  Gene Symbol: CASD1
  Gene Name: CAS1 domain containing 1
  ENSP ID: ENSP00000389718
MAALAYNLGKREINHYFSVRSAKVLALVAVLLLAACHLASRRYRA

SEQ ID NO: 12042 - protein, 125 aa, Homo sapiens
  Payload ID: 2386
  Gene Symbol: CASD1
  Gene Name: CAS1 domain containing 1
  ENSP ID: ENSP00000396261
MMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPL

SEQ ID NO: 12043 - protein, 103 aa, Homo sapiens
  Payload ID: 2386
  Gene Symbol: CASD1
  Gene Name: CAS1 domain containing 1
  ENSP ID: ENSP00000402708
MAALAYNLGKREINHYFSVRSAKVLALVAVLLLAACHLASRRYRGNDSCEYLLSSGRFLGEKVWQPHSCMMHKYKISMKTFLLKTRLHQLKWIFCGILKLMVL

SEQ ID NO: 12044 - protein, 185 aa, Homo sapiens
  Payload ID: 2387
  Gene Symbol: CSN1S1
  Gene Name: casein alpha s1
  Uniprot ID: P47710
  ENSP ID: ENSP00000246891
MRLLILTCLVAVALARPKLPLRYPERLQNPSESSEPIPLESREEYMNGMNRQRNILREKQTDEIKDTRNESTQNCVVAEPEKMESSISSSSEEMSLSKCAEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 12045 - protein, 76 aa, Homo sapiens
  Payload ID: 2387
  Gene Symbol: CSN1S1
  Gene Name: casein alpha s1
  ENSP ID: ENSP00000421314
KMESSISSSSEEQIRRMNENSHVQVPFQQLNQLAAYPYAVWYYPQIMQYVPFPPFSDISNPTAHENYEKNNVMLQW

SEQ ID NO: 12046 - protein, 176 aa, Homo sapiens
  Payload ID: 2387
  Gene Symbol: CSN1S1
  Gene Name: casein alpha s1
  Uniprot ID: P47710
  ENSP ID: ENSP00000422611
MRLLILTCLVAVALARPKLPLRYPERLQNPSESSEPIPLESREEYMNGMNRRNILREKQTDEIKDTRNESTQNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 12047 - protein, 169 aa, Homo sapiens
  Payload ID: 2387
  Gene Symbol: CSN1S1
  Gene Name: casein alpha s1
  ENSP ID: ENSP00000426684
MRLLILTCLVAVALARPKLPLRYPERLQNPSESSEPIPLESREEYMNGMNRQRNILREKQTDEIKNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 12048 - protein, 177 aa, Homo sapiens
  Payload ID: 2387
  Gene Symbol: CSN1S1
  Gene Name: casein alpha s1
  ENSP ID: ENSP00000427490
MRLLILTCLVAVALARPKLPLRYPERLQNPSESSEPIPLESREEYMNGMNRQRNILREKQTDEIKDTRNESTQNCVVAEPEKMESSISSSSEEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 12049 - protein, 55 aa, Homo sapiens
  Payload ID: 2387
  Gene Symbol: CSN1S1
  Gene Name: casein alpha s1
  ENSP ID: ENSP00000487633
QRNILREKQTDEIKNCVVAEPEKMESSISSSSEEMSLSKCAEQFCRLNEYNQLQL

SEQ ID NO: 12050 - protein, 226 aa, Homo sapiens
  Payload ID: 2388
  Gene Symbol: CSN2
  Gene Name: casein beta
  Uniprot ID: P05814
  ENSP ID: ENSP00000341030
MKVLILACLVALALARETIESLSSSEESITEYKQKVEKVKHEDQQQGEDEHQDKIYPSFQPQPLIYPFVEPIPYGFLPQNILPLAQPAVVLPVPQPEIMEVPKAKDTVYTKGRVMPVLKSPTIPFFDPQIPKLTDLENLHLPLPLLQPLMQQVPQPIPQTLALPPQPLWSVPQPKVLPIPQQVVPYPQRAVPVQALLLNQELLLNPTHQIYPVTQPLAPVHNPISV

SEQ ID NO: 12051 - protein, 226 aa, Homo sapiens; identical to SEQ ID NO: 12050
  Payload ID: 2388
  Gene Symbol: CSN2
  Gene Name: casein beta
  ENSP ID: ENSP00000489488

SEQ ID NO: 12052 - protein, 182 aa, Homo sapiens
  Payload ID: 2389
  Gene Symbol: CSN3
  Gene Name: casein kappa
  Uniprot ID: P07498
  ENSP ID: ENSP00000304822
MKSFLLVVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 12053 - protein, 325 aa, Homo sapiens
  Payload ID: 2390
  Gene Symbol: CSNK1A1
  Gene Name: casein kinase 1, alpha 1
  Uniprot ID: P48729
  ENSP ID: ENSP00000261798
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 12054 - protein, 337 aa, Homo sapiens
  Payload ID: 2390
  Gene Symbol: CSNK1A1
  Gene Name: casein kinase 1, alpha 1
  Uniprot ID: P48729
  ENSP ID: ENSP00000367074
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 12055 - protein, 89 aa, Homo sapiens
  Payload ID: 2390
  Gene Symbol: CSNK1A1
  Gene Name: casein kinase 1, alpha 1
  ENSP ID: ENSP00000421268
MASSSGSKAEFIVGGKYKLVRKIGSGSFGDIYLAINITNGEEVAVKLESQKARHPQLLYESKLYKILQGGVGIPHIRSPEWIKPLKSQE

SEQ ID NO: 12056 - protein, 365 aa, Homo sapiens
  Payload ID: 2390
  Gene Symbol: CSNK1A1
  Gene Name: casein kinase 1, alpha 1
  Uniprot ID: P48729
  ENSP ID: ENSP00000421689
MASSSGSKAEFIVGGKYKLVRKIGSGSFGDIYLAINITNGEEVAVKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKCLESPVGKRKRSMTVSTSQDPSFSGLNQLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 12057 - protein, 167 aa, Homo sapiens
  Payload ID: 2390
  Gene Symbol: CSNK1A1
  Gene Name: casein kinase 1, alpha 1
  ENSP ID: ENSP00000425366
  MOD_RES (1)..(1): Any amino acid
XQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKG

SEQ ID NO: 12058 - protein, 236 aa, Homo sapiens
  Payload ID: 2390
  Gene Symbol: CSNK1A1
  Gene Name: casein kinase 1, alpha 1
  ENSP ID: ENSP00000426747
MDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 12059 - protein, 264 aa, Homo sapiens
  Payload ID: 2390
  Gene Symbol: CSNK1A1
  Gene Name: casein kinase 1, alpha 1
  ENSP ID: ENSP00000427031
MDLLGPSLEDLFNFCSRRFTMKTVLMLADQMISRIEYVHTKNFIHRDIKPDNFLMGIGRHCNKCLESPVGKRKRSMTVSTSQDPSFSGLNQLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGF

SEQ ID NO: 12060 - protein, 78 aa, Homo sapiens
  Payload ID: 2390
  Gene Symbol: CSNK1A1
  Gene Name: casein kinase 1, alpha 1
  ENSP ID: ENSP00000430252
MASSSGSKAEFIVGGKYKLVRKIGSGSFGDIYLAINITNGEEVAVKLESQKARHPQLLYESKLYKILQGGVGIPHIRM

SEQ ID NO: 12061 - protein, 134 aa, Homo sapiens
  Payload ID: 2390
  Gene Symbol: CSNK1A1
  Gene Name: casein kinase 1, alpha 1
  ENSP ID: ENSP00000475319
MESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGF

SEQ ID NO: 12062 - protein, 96 aa, Homo sapiens
  Payload ID: 2390
  Gene Symbol: CSNK1A1
  Gene Name: casein kinase 1, alpha 1
  ENSP ID: ENSP00000475633
MSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKG

SEQ ID NO: 12063 - protein, 184 aa, Homo sapiens
  Payload ID: 2390
  Gene Symbol: CSNK1A1
  Gene Name: casein kinase 1, alpha 1
  ENSP ID: ENSP00000475969
  MOD_RES (1)..(1): Any amino acid
XGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKTKSNMKGNADESARVGLWSSGVHVSKTAGPSNSATC

SEQ ID NO: 12064 - protein, 166 aa, Homo sapiens
  Payload ID: 2390
  Gene Symbol: CSNK1A1
  Gene Name: casein kinase 1, alpha 1
  ENSP ID: ENSP00000479826
MFLVLKKKHICHRNLVNILQLNMYVCCLDKCNHCKHLYDLGFCFYFEMGAFLFTSSLKTKNCFCKEMRFFLNNKKCLADSLLNKNLPNFLIDYFKPFVTWYSFASQFRFRVITFPLFLRKMKKVILLSEGERHSFIFFFFFFFFYDLQAQYLVLQLPELGIVAAAR

SEQ ID NO: 12065 - protein, 337 aa, Homo sapiens
  Payload ID: 2391
  Gene Symbol: CSNK1A1L
  Gene Name: casein kinase 1, alpha 1-like
  Uniprot ID: Q8N752
  ENSP ID: ENSP00000369126
MTNNSGSKAELVVGGKYKLVRKIGSGSFGDVYLGITTTNGEDVAVKLESQKVKHPQLLYESKLYTILQGGVGIPHMHWYGQEKDNNVLVMDLLGPSLEDLFNFCSRRFTMKTVLMLADQMISRIEYVHTKNFLHRDIKPDNFLMGTGRHCNKLFLIDFGLAKKYRDNRTRQHIPYREDKHLIGTVRYASINAHLGIEQSRRDDMESLGYVFMYFNRTSLPWQGLRAMTKKQKYEKISEKKMSTPVEVLCKGFPAEFAMYLNYCRGLRFEEVPDYMYLRQLFRILFRTLNHQYDYTFDWTMLKQKAAQQAASSSGQGQQAQTQTGKQTEKNKNNVKDN

SEQ ID NO: 12066 - protein, 120 aa, Homo sapiens
  Payload ID: 2392
  Gene Symbol: CSNK1D
  Gene Name: casein kinase 1, delta
  ENSP ID: ENSP00000269361
  MOD_RES (1)..(1): Any amino acid
XLLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIGAEGCHQETEIRKD

SEQ ID NO: 12067 - protein, 415 aa, Homo sapiens [sequence omitted]

SEQ ID NO: 12068 - protein, 409 aa, Homo sapiens
  Payload ID: 2392
  Gene Symbol: CSNK1D
  Gene Name: casein kinase 1, delta
  Uniprot ID: P48730
  ENSP ID: ENSP00000376146
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQNSIPFEHHGK

SEQ ID NO: 12069 - protein, 427 aa, Homo sapiens
  Payload ID: 2392
  Gene Symbol: CSNK1D
  Gene Name: casein kinase 1, delta
  ENSP ID: ENSP00000381531
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTASGRLRGTQEVAPPTPLTPTSHTANTSPRPVSGMERERKVSMRLHRGAPVNISSSDLTGRQDTSRMSTSQRSRDMASLRLHAARQGTRCRPQRPRRTY

SEQ ID NO: 12070 - protein, 126 aa, Homo sapiens
  Payload ID: 2392
  Gene Symbol: CSNK1D
  Gene Name: casein kinase 1, delta
  ENSP ID: ENSP00000385769
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMNNPEEMTWSLWATC

SEQ ID NO: 12071 - protein, 64 aa, Homo sapiens
  Payload ID: 2392
  Gene Symbol: CSNK1D
  Gene Name: casein kinase 1, delta
  ENSP ID: ENSP00000462079
  MOD_RES (1)..(1): Any amino acid
XRERKVSMRLHRGAPVNISSSDLTGRQDTSRMSTSQRSRDMASLRLHAARQGTRCRPQRPRRTY

SEQ ID NO: 12072 - protein, 56 aa, Homo sapiens
  Payload ID: 2392
  Gene Symbol: CSNK1D
  Gene Name: casein kinase 1, delta
  ENSP ID: ENSP00000462144
MELRVGNRYRLGRKIGSGSFGDIYLGWSAVARSRLTASSASQRWGFTVLARMVSIS

SEQ ID NO: 12073 - protein, 187 aa, Homo sapiens
  Payload ID: 2392
  Gene Symbol: CSNK1D
  Gene Name: casein kinase 1, delta
  ENSP ID: ENSP00000463757
MELRVGNRYRLGRKIGSGSFGDIYLVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQK

SEQ ID NO: 12074 - protein, 20 aa, Homo sapiens
  Payload ID: 2392
  Gene Symbol: CSNK1D
  Gene Name: casein kinase 1, delta
  ENSP ID: ENSP00000463906
  MOD_RES (1)..(1): Any amino acid
XMTTCSTGTCSNLLLSRLKI

SEQ ID NO: 12075 - protein, 43 aa, Homo sapiens
  Payload ID: 2392
  Gene Symbol: CSNK1D
  Gene Name: casein kinase 1, delta
  ENSP ID: ENSP00000464551
MELRVGNRYRLGRKIGSGSFGDIYLVEMGFHRVSQDGLNLLTL

SEQ ID NO: 12076 - protein, 416 aa, Homo sapiens
  Payload ID: 2393
  Gene Symbol: CSNK1E
  Gene Name: casein kinase 1, epsilon
  Uniprot ID: P49674
  ENSP ID: ENSP00000352929
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 12077 - protein, 416 aa, Homo sapiens; identical to SEQ ID NO: 12076
  Payload ID: 2393
  Gene Symbol: CSNK1E
  Gene Name: casein kinase 1, epsilon
  Uniprot ID: P49674
  ENSP ID: ENSP00000380044

SEQ ID NO: 12078 - protein, 416 aa, Homo sapiens; identical to SEQ ID NO: 12076
  Payload ID: 2393
  Gene Symbol: CSNK1E
  Gene Name: casein kinase 1, epsilon
  Uniprot ID: P49674
  ENSP ID: ENSP00000383067

SEQ ID NO: 12079 - protein, 416 aa, Homo sapiens; identical to SEQ ID NO: 12076
  Payload ID: 2393
  Gene Symbol: CSNK1E
  Gene Name: casein kinase 1, epsilon
  Uniprot ID: P49674
  ENSP ID: ENSP00000384074

SEQ ID NO: 12080 - protein, 311 aa, Homo sapiens
  Payload ID: 2393
  Gene Symbol: CSNK1E
  Gene Name: casein kinase 1, epsilon
  ENSP ID: ENSP00000384426
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFTDTVQDGSHWPHATHF

SEQ ID NO: 12081 - protein, 91 aa, Homo sapiens
  Payload ID: 2393
  Gene Symbol: CSNK1E
  Gene Name: casein kinase 1, epsilon
  ENSP ID: ENSP00000397460
  MOD_RES (1)..(1): Any amino acid
XSCTSTWAPCPGRGSKQPPSARSMNGSARRRCQRPSRSSAKAIPPNSQHTSTSAAPCGLTTSPTTLTYVSSSATSSTGRASPMTTSLTGTC

SEQ ID NO: 12082 - protein, 119 aa, Homo sapiens
  Payload ID: 2393
  Gene Symbol: CSNK1E
  Gene Name: casein kinase 1, epsilon
  ENSP ID: ENSP00000400494
  MOD_RES (1)..(1): Any amino acid
XRNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 12083 - protein, 270 aa, Homo sapiens
  Payload ID: 2393
  Gene Symbol: CSNK1E
  Gene Name: casein kinase 1, epsilon
  ENSP ID: ENSP00000403057
  MOD_RES (1)..(1): Any amino acid
XGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGASSSQAQPRDSPMTAKGPFCPRPCPCAGPTYSPTYW

SEQ ID NO: 12084 - protein, 144 aa, Homo sapiens
  Payload ID: 2393
  Gene Symbol: CSNK1E
  Gene Name: casein kinase 1, epsilon
  ENSP ID: ENSP00000403610
  MOD_RES (1)..(1): Any amino acid
XRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 12085 - protein, 336 aa, Homo sapiens
  Payload ID: 2393
  Gene Symbol: CSNK1E
  Gene Name: casein kinase 1, epsilon
  ENSP ID: ENSP00000407235
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFARSTSPPTAAGLTAFLEVPLEAGPGVRSWAEAPTALSFANL

SEQ ID NO: 12086 - protein, 118 aa, Homo sapiens
  Payload ID: 2393
  Gene Symbol: CSNK1E
  Gene Name: casein kinase 1, epsilon
  ENSP ID: ENSP00000412194
  MOD_RES (1)..(1): Any amino acid
XRPATLPSTRTWALSKAVEMTWRAWATCSCTSTWAPCPGRGSKQPPSARSMNGSARRRCQRPSRSSAKAIPPNSQHTSTSAAPCGLTTSPTTLTYVSSSATSSTGRASPMTTSLTGTC

SEQ ID NO: 12087 - protein, 225 aa, Homo sapiens
  Payload ID: 2393
  Gene Symbol: CSNK1E
  Gene Name: casein kinase 1, epsilon
  ENSP ID: ENSP00000412335
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKY

SEQ ID NO: 12088 - protein, 422 aa, Homo sapiens
  Payload ID: 2394
  Gene Symbol: CSNK1G1
  Gene Name: casein kinase 1, gamma 1
  Uniprot ID: Q9HCP0
  ENSP ID: ENSP00000305777
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 12089 - protein, 393 aa, Homo sapiens
  Payload ID: 2394
  Gene Symbol: CSNK1G1
  Gene Name: casein kinase 1, gamma 1
  Uniprot ID: Q9HCP0
  ENSP ID: ENSP00000475325
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQSLRTVTAEHYDVNNSAIWHRGRGT

SEQ ID NO: 12090 - protein, 422 aa, Homo sapiens
  Payload ID: 2394
  Gene Symbol: CSNK1G1
  Gene Name: casein kinase 1, gamma 1
  ENSP ID: ENSP00000475686
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQPRSLTSRVFCPAVRPLFPLPSTHINRNNVLEMKPGGRSSYTCKRSLIGSTLTR

SEQ ID NO: 12091 - protein, 475 aa, Homo sapiens
  Payload ID: 2394
  Gene Symbol: CSNK1G1
  Gene Name: casein kinase 1, gamma 1
  ENSP ID: ENSP00000475724
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQNVSSERRGEWEIQPSRQTNTSYLTSHLAADRHGGSVQVVSSTNGELNVDDPTGAHSNAPITAHAEVEVVEEAKCIMFHKPWHWSQSSAVKMKFVVFLNMNVNFKCI

SEQ ID NO: 12092 - protein, 438 aa, Homo sapiens
  Payload ID: 2394
  Gene Symbol: CSNK1G1
  Gene Name: casein kinase 1, gamma 1
  ENSP ID: ENSP00000476088
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCIMFHKPWHWSQSSAVKMKFVVFLNMNVNFKCI

SEQ ID NO: 12093 - protein, 173 aa, Homo sapiens
  Payload ID: 2394
  Gene Symbol: CSNK1G1
  Gene Name: casein kinase 1, gamma 1
  ENSP ID: ENSP00000488990
ATYLRYVRRLDFFEKPDYEYLRTLFTDLFEKKGYTFDYAYDWVGRPIPTPVGSVHVDSGASAITRESHTHRDRPSQQQPLRNQNVSSERRGEWEIQPSRQTNTSYLTSHLAADRHGGSVQPRSLTSRVFCPAVRPLFPLPSTHINRNNVLEMKPGGRSSYTCKRSLIGSTLTR

SEQ ID NO: 12094 - protein, 114 aa, Homo sapiens
  Payload ID: 2394
  Gene Symbol: CSNK1G1
  Gene Name: casein kinase 1, gamma 1
  ENSP ID: ENSP00000489008
MDHPSREKDERQRTTKPMAQRSAHCSRPSGSSSSSGVLMVGPNFRVGKKIGCGNFGELRLGKNLYTNEYVAIKLVKVSHRCITLDHVGNIMPWCWSSLALAWRTCLTSVTEHLL

SEQ ID NO: 12095 - protein, 138 aa, Homo sapiens
  Payload ID: 2394
  Gene Symbol: CSNK1G1
  Gene Name: casein kinase 1, gamma 1
  ENSP ID: ENSP00000489046
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTL

SEQ ID NO: 12096 - protein, 204 aa, Homo sapiens
  Payload ID: 2394
  Gene Symbol: CSNK1G1
  Gene Name: casein kinase 1, gamma 1
  ENSP ID: ENSP00000489050
QKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQNVSSERRGEWEIQPSRQTNTSYLTSHLAADRHGGSVQVVSSTNGELNVDDPTGAHSNAPITAHAEVEVVEEANCLKMLNLWCCCFFKRKRKKTAQRHK

SEQ ID NO: 12097 - protein, 67 aa, Homo sapiens
  Payload ID: 2394
  Gene Symbol: CSNK1G1
  Gene Name: casein kinase 1, gamma 1
  ENSP ID: ENSP00000489090
DLFEKKGYTFDYAYDWVGRPIPTPVGSVHVDSGASAITRESHTHRDRPSQQQPLRNQVDCSLANSPI

SEQ ID NO: 12098 - protein, 459 aa, Homo sapiens
  Payload ID: 2394
  Gene Symbol: CSNK1G1
  Gene Name: casein kinase 1, gamma 1
  ENSP ID: ENSP00000489116
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQNVSSERRGEWEIQPSRQTNTSYLTSHLAADRHGGSVQVVSSTNGELNVDDPTGAHSNAPITAHAEVEVVEEAKCCCFFKRKRKKTAQRHK

SEQ ID NO: 12099 - protein, 430 aa, Homo sapiens
  Payload ID: 2394
  Gene Symbol: CSNK1G1
  Gene Name: casein kinase 1, gamma 1
  ENSP ID: ENSP00000489165
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEANCLKMLNLWCCCFFKRKRKKTAQRHK

SEQ ID NO: 12100 - protein, 36 aa, Homo sapiens
  Payload ID: 2394
  Gene Symbol: CSNK1G1
  Gene Name: casein kinase 1, gamma 1
  ENSP ID: ENSP00000489172
  MOD_RES (1)..(1): Any amino acid
XGSVHVDSGASAITRESHTHRDRPSQQQPLRNQSTV

SEQ ID NO: 12101 - protein, 459 aa, Homo sapiens; identical to SEQ ID NO: 12098
  Payload ID: 2394
  Gene Symbol: CSNK1G1
  Gene Name: casein kinase 1, gamma 1
  ENSP ID: ENSP00000489233

SEQ ID NO: 12102 - protein, 183 aa, Homo sapiens
  Payload ID: 2394
  Gene Symbol: CSNK1G1
  Gene Name: casein kinase 1, gamma 1
  ENSP ID: ENSP00000489277
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVI

SEQ ID NO: 12103 - protein, 158 aa, Homo sapiens
  Payload ID: 2394
  Gene Symbol: CSNK1G1
  Gene Name: casein kinase 1, gamma 1
  ENSP ID: ENSP00000489310
FFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKYVHLSRGLLSHGLKNLFCLFLSVCCSSQTGFLMLVTTAFFLNCFNFCMVP

SEQ ID NO: 12104 - protein, 422 aa, Homo sapiens; identical to SEQ ID NO: 12090
  Payload ID: 2394
  Gene Symbol: CSNK1G1
  Gene Name: casein kinase 1, gamma 1
  ENSP ID: ENSP00000489415

SEQ ID NO: 12105 - protein, 77 aa, Homo sapiens
  Payload ID: 2394
  Gene Symbol: CSNK1G1
  Gene Name: casein kinase 1, gamma 1
  ENSP ID: ENSP00000489534
MDHPSREKDERQRTTKPMAQRSAHCSRPSGSSSSSGVLMVGPNFRVGKKIGCGNFGELRLGTNKITCSTASFRVQIL

SEQ ID NO: 12106 - protein, 415 aa, Homo sapiens
  Payload ID: 2395
  Gene Symbol: CSNK1G2
  Gene Name: casein kinase 1, gamma 2
  Uniprot ID: P78368
  ENSP ID: ENSP00000255641
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 12107 - protein, 83 aa, Homo sapiens
  Payload ID: 2395
  Gene Symbol: CSNK1G2
  Gene Name: casein kinase 1, gamma 2
  ENSP ID: ENSP00000465106
MDFDKKGGKGETEEGRRMSKAGGGRSSHGIRSSGTSSGVLMVGPNFRVGKKIGCGNFGELRLGWFQRCWGKAEGKHERLQGQG

SEQ ID NO: 12108 - protein, 76 aa, Homo sapiens
  Payload ID: 2395
  Gene Symbol: CSNK1G2
  Gene Name: casein kinase 1, gamma 2
  ENSP ID: ENSP00000467214
MDFDKKGGKGETEEGRRMSKAGGGRSSHGIRSSGTSSGVLMVGPNFRVGKKIGCGNFGELRLGKNLYTNEYVAIKL

SEQ ID NO: 12109 - protein, 299 aa, Homo sapiens
  Payload ID: 2395
  Gene Symbol: CSNK1G2
  Gene Name: casein kinase 1, gamma 2
  ENSP ID: ENSP00000468637
  MOD_RES (1)..(1): Any amino acid
XSKAGGGRSSHGIRSSGTSSGVLMVGPNFRVGKKIGCGNFGELRLGKNLYTNEYVAIKLVSRPLHPTPADVPPRDFRAATRSPGDSLLCPQEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFP

SEQ ID NO: 12110 - protein, 100 aa, Homo sapiens
  Payload ID: 2395
  Gene Symbol: CSNK1G2
  Gene Name: casein kinase 1, gamma 2
  ENSP ID: ENSP00000480052
  MOD_RES (1)..(1): Any amino acid
XRPGRRAGTQGGSKADHRPPQADTLKERYQKIGDTKRATPIEVLCENFPEEMATYLRYVRRLDFFEKPDYDYLRKLFTDLFDRSGFVFDYEYDWAGKPLP

SEQ ID NO: 12111 - protein, 235 aa, Homo sapiens
  Payload ID: 2395
  Gene Symbol: CSNK1G2
  Gene Name: casein kinase 1, gamma 2
  ENSP ID: ENSP00000480185
  MOD_RES (1)..(1): Any amino acid
XSRAPQLHLEYRFYKQLSATGTGRPAGGAGAAQGQGGGCRRTPVRLSSAAEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFP

SEQ ID NO: 12112 - protein, 206 aa, Homo sapiens
  Payload ID: 2395
  Gene Symbol: CSNK1G2
  Gene Name: casein kinase 1, gamma 2
  ENSP ID: ENSP00000480929
  MOD_RES (1)..(1): Any amino acid
XSRAPQLHLEYRFYKQLSATGTGRPAGGAGAAQGQGGGCRRTPVRLSSAAEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKGRHAQGAVPEDRGHQTRHAHRGALRELP

SEQ ID NO: 12113 - protein, 114 aa, Homo sapiens
  Payload ID: 2395
  Gene Symbol: CSNK1G2
  Gene Name: casein kinase 1, gamma 2
  ENSP ID: ENSP00000482716
FMYFLRGSLPWQGLKADTLKERYQKIGDTKRATPIEVLCENFPEEMATYLRYVRRLDFFEKPDYDYLRKLFTDLFDRSGFVFDYDRPPSAPSTPTCPPSLSSGTKPSRTAKTRR

SEQ ID NO: 12114 - protein, 423 aa, Homo sapiens
  Payload ID: 2396
  Gene Symbol: CSNK1G3
  Gene Name: casein kinase 1, gamma 3
  Uniprot ID: Q9Y6M4
  ENSP ID: ENSP00000334735
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 12115 - protein, 455 aa, Homo sapiens
  Payload ID: 2396
  Gene Symbol: CSNK1G3
  Gene Name: casein kinase 1, gamma 3
  Uniprot ID: Q9Y6M4
  ENSP ID: ENSP00000353904
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQSADHRAAWDSQQANPHHLRAHLAADRHGGSVQVVSSTNGELNTDDPTAGRSNAPITAPTEVEVMDETNCQKVLNMWCCCFFKRRKRKTIQRHK

SEQ ID NO: 12116 - protein, 447 aa, Homo sapiens
  Payload ID: 2396
  Gene Symbol: CSNK1G3
  Gene Name: casein kinase 1, gamma 3
  Uniprot ID: Q9Y6M4
  ENSP ID: ENSP00000354942
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQSADHRAAWDSQQANPHHLRAHLAADRHGGSVQVVSSTNGELNTDDPTAGRSNAPITAPTEVEVMDETKCCCFFKRRKRKTIQRHK

SEQ ID NO: 12117 - protein, 311 aa, Homo sapiens
  Payload ID: 2396
  Gene Symbol: CSNK1G3
  Gene Name: casein kinase 1, gamma 3
  Uniprot ID: Q9Y6M4
  ENSP ID: ENSP00000421385
MVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 12118 - protein, 348 aa, Homo sapiens
  Payload ID: 2396
  Gene Symbol: CSNK1G3
  Gene Name: casein kinase 1, gamma 3
  Uniprot ID: Q9Y6M4
  ENSP ID: ENSP00000421998
MKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 12119 - protein, 424 aa, Homo sapiens
  Payload ID: 2396
  Gene Symbol: CSNK1G3
  Gene Name: casein kinase 1, gamma 3
  Uniprot ID: Q9Y6M4
  ENSP ID: ENSP00000423838
MENKKKDKDKSDDRMARPSGRSGHNTRGTGSSSSGVLMVGPNFRVGKKIGCGNFGELRLGKNLYTNEYVAIKLEPMKSRAPQLHLEYRFYKQLGSGDGIPQVYYFGPCGKYNAMVLELLGPSLEDLFDLCDRTFSLKTVLMIAIQLISRMEYVHSKNLIYRDVKPENFLIGRPGNKTQQVIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETNCQKVLNMWCCCFFKRRKRKTIQRHK

SEQ ID NO: 12120 - protein, 423 aa, Homo sapiens; identical to SEQ ID NO: 12114
  Payload ID: 2396
  Gene Symbol: CSNK1G3
  Gene Name: casein kinase 1, gamma 3
  Uniprot ID: Q9Y6M4
  ENSP ID: ENSP00000429412

SEQ ID NO: 12121 - protein, 164 aa, Homo sapiens
  Payload ID: 2396
  Gene Symbol: CSNK1G3
  Gene Name: casein kinase 1, gamma 3
  ENSP ID: ENSP00000429914
  MOD_RES (1)..(1): Any amino acid
XADTLKERYQKIGDTKRATPIEVLCENFPEEMATYLRYVRRLDFFEKPDYDYLRKLFTDLFDRKGYMFDYEYDWIGKQLPTPVGAVQQDPALSSNREAHQHRDKMQQSKNQVVSSTNGELNTDDPTAGRSNAPITAPTEVEVMDETKCCCFFKRRKRKTIQRHK

SEQ ID NO: 12122 - protein, 391 aa, Homo sapiens
  Payload ID: 2397
  Gene Symbol: CSNK2A1
  Gene Name: casein kinase 2, alpha 1 polypeptide
  Uniprot ID: P68400
  ENSP ID: ENSP00000217244
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 12123 - protein, 391 aa, Homo sapiens; identical to SEQ ID NO: 12122
  Payload ID: 2397
  Gene Symbol: CSNK2A1
  Gene Name: casein kinase 2, alpha 1 polypeptide
  Uniprot ID: P68400
  ENSP ID: ENSP00000339247

SEQ ID NO: 12124 - protein, 255 aa, Homo sapiens
  Payload ID: 2397
  Gene Symbol: CSNK2A1
  Gene Name: casein kinase 2, alpha 1 polypeptide
  Uniprot ID: P68400
  ENSP ID: ENSP00000383076
MYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 12125 - protein, 385 aa, Homo sapiens
  Payload ID: 2397
  Gene Symbol: CSNK2A1
  Gene Name: casein kinase 2, alpha 1 polypeptide
  ENSP ID: ENSP00000383086
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSEMKFCRVAQAGLELLSSTVYPPWPPKVLRLEA

SEQ ID NO: 12126 - protein, 79 aa, Homo sapiens
  Payload ID: 2397
  Gene Symbol: CSNK2A1
  Gene Name: casein kinase 2, alpha 1 polypeptide
  ENSP ID: ENSP00000476486
MSGPVPSRARVYTDVNTHRPREYWDYESHVVEWGNQDDYQLVRKLGRGKYSEVFEAINITNNEKVVVKILKPVKKKKIK

SEQ ID NO: 12127 - protein, 74 aa, Homo sapiens
  Payload ID: 2397
  Gene Symbol: CSNK2A1
  Gene Name: casein kinase 2, alpha 1 polypeptide
  ENSP ID: ENSP00000476547
MSGPVPSRARVYTDVNTHRPREYWDYESHVVEWGNQDDYQLVRKLGRGKYSEVFEAINITNNEKVVVKILKPVK

SEQ ID NO: 12128 - protein, 27 aa, Homo sapiens
  Payload ID: 2397
  Gene Symbol: CSNK2A1
  Gene Name: casein kinase 2, alpha 1 polypeptide
  ENSP ID: ENSP00000477147
MYEILKALDYCHSMGIMHRDVKPHNVM

SEQ ID NO: 12129 - protein, 397 aa, Homo sapiens
  Payload ID: 2397
  Gene Symbol: CSNK2A1
  Gene Name: casein kinase 2, alpha 1 polypeptide
  ENSP ID: ENSP00000479630
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGCLFQLPLRSAVTALSVS

SEQ ID NO: 12130 - protein, 118 aa, Homo sapiens
  Payload ID: 2397
  Gene Symbol: CSNK2A1
  Gene Name: casein kinase 2, alpha 1 polypeptide
  ENSP ID: ENSP00000481572
DYIDKYNIELDPRFNDILGRHSRKRWERFVHSENQHLVSPEALDFLDKLLRYDHQSRLTAREAMEHPYFYTVVKDQARMGSSSMPGGSTPVSSANMMSEPQFEGQRDIHHAAVRLGQL

SEQ ID NO: 12131 - protein, 391 aa, Homo sapiens [sequence omitted]

SEQ ID NO: 12132 - protein, 350 aa, Homo sapiens
  Payload ID: 2399
  Gene Symbol: CSNK2A2
  Gene Name: casein kinase 2, alpha prime polypeptide
  Uniprot ID: P19784
  ENSP ID: ENSP00000262506
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 12133 - protein, 135 aa, Homo sapiens
  Payload ID: 2399
  Gene Symbol: CSNK2A2
  Gene Name: casein kinase 2, alpha prime polypeptide
  ENSP ID: ENSP00000454874
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIR

SEQ ID NO: 12134 - protein, 230 aa, Homo sapiens
  Payload ID: 2399
  Gene Symbol: CSNK2A2
  Gene Name: casein kinase 2, alpha prime polypeptide
  ENSP ID: ENSP00000456606
PVKKKKIKREVKILENLRGGTNIIKLIDTVKDPVSKTPALVFEYINNTDFKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 12135 - protein, 152 aa, Homo sapiens
  Payload ID: 2399
  Gene Symbol: CSNK2A2
  Gene Name: casein kinase 2, alpha prime polypeptide
  ENSP ID: ENSP00000457911
  MOD_RES (1)..(1): Any amino acid
XGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 12136 - protein, 215 aa, Homo sapiens
  Payload ID: 2400
  Gene Symbol: CSNK2B
  Gene Name: casein kinase 2, beta polypeptide
  Uniprot ID: P67870
  ENSP ID: ENSP00000365025
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 12137 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000365026

SEQ ID NO: 12138 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000365042

SEQ ID NO: 12139 - protein, 234 aa, Homo sapiens
  Payload ID: 2400
  Gene Symbol: CSNK2B
  Gene Name: casein kinase 2, beta polypeptide
  ENSP ID: ENSP00000365046
MEKCKGTSRMAGTTSADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 12140 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000372919

SEQ ID NO: 12141 - protein, 228 aa, Homo sapiens
  Payload ID: 2400
  Gene Symbol: CSNK2B
  Gene Name: casein kinase 2, beta polypeptide
  ENSP ID: ENSP00000372923
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPSSCSRHPDVPLLPRRRPFCRMHFRLREVYHQQLIPVHGDHHLL

SEQ ID NO: 12142 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000372925

SEQ ID NO: 12143 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000382980

SEQ ID NO: 12144 - protein, 234 aa, Homo sapiens; identical to SEQ ID NO: 12139
  Payload ID: 2400
  Gene Symbol: CSNK2B
  Gene Name: casein kinase 2, beta polypeptide
  ENSP ID: ENSP00000382984

SEQ ID NO: 12145 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000389767

SEQ ID NO: 12146 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000390900

SEQ ID NO: 12147 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000391038

SEQ ID NO: 12148 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000393756

SEQ ID NO: 12149 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000394855

SEQ ID NO: 12150 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000395275

SEQ ID NO: 12151 - protein, 234 aa, Homo sapiens; identical to SEQ ID NO: 12139
  Payload ID: 2400
  Gene Symbol: CSNK2B
  Gene Name: casein kinase 2, beta polypeptide
  ENSP ID: ENSP00000395546

SEQ ID NO: 12152 - protein, 234 aa, Homo sapiens; identical to SEQ ID NO: 12139
  Payload ID: 2400
  Gene Symbol: CSNK2B
  Gene Name: casein kinase 2, beta polypeptide
  ENSP ID: ENSP00000396772

SEQ ID NO: 12153 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000400188

SEQ ID NO: 12154 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000407018

SEQ ID NO: 12155 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000407379

SEQ ID NO: 12156 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000407844

SEQ ID NO: 12157 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000407864

SEQ ID NO: 12158 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000409510

SEQ ID NO: 12159 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000410802

SEQ ID NO: 12160 - protein, 234 aa, Homo sapiens; identical to SEQ ID NO: 12139
  Payload ID: 2400
  Gene Symbol: CSNK2B
  Gene Name: casein kinase 2, beta polypeptide
  ENSP ID: ENSP00000410942

SEQ ID NO: 12161 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000411322

SEQ ID NO: 12162 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000412520

SEQ ID NO: 12163 - protein, 234 aa, Homo sapiens; identical to SEQ ID NO: 12139
  Payload ID: 2400
  Gene Symbol: CSNK2B
  Gene Name: casein kinase 2, beta polypeptide
  ENSP ID: ENSP00000413092

SEQ ID NO: 12164 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000413469

SEQ ID NO: 12165 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000415237

SEQ ID NO: 12166 - protein, 215 aa, Homo sapiens; identical to SEQ ID NO: 12136
  Payload ID: 2400
  Gene Symbol: CSNK2B
  Gene Name: casein kinase 2, beta polypeptide
  Uniprot ID: P67870
  ENSP ID: ENSP00000415303

SEQ ID NO: 12167 - protein, 234 aa, Homo sapiens; identical to SEQ ID NO: 12139
  Payload ID: 2400
  Gene Symbol: CSNK2B
  Gene Name: casein kinase 2, beta polypeptide
  ENSP ID: ENSP00000415615

SEQ ID NO: 12168 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000477593

SEQ ID NO: 12169 - protein, 161 aa, Homo sapiens
  Payload ID: 2400
  Gene Symbol: CSNK2B
  Gene Name: casein kinase 2, beta polypeptide
  ENSP ID: ENSP00000477727
MSSSEEVSWISWFCGLRGNEFFCEVDEDYIQDKFNLTGLNEQVPHYRQALDMILDLEPDEELEDNPNQSDLIEQAAEMLYGLIHALPLSDSQIQWFYQALNLSLPLPNFHAGTEPDGLDPMVTLSLNLGLSFAELRRMYLFLNSSGLLVLPQAGLLTPHPS

SEQ ID NO: 12170 - protein, 304 aa, Homo sapiens
  Payload ID: 2400
  Gene Symbol: CSNK2B
  Gene Name: casein kinase 2, beta polypeptide
  ENSP ID: ENSP00000478364
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELCRMYLFLNSSGLLVLPQAGLLTPHPS

SEQ ID NO: 12171 - protein, 161 aa, Homo sapiens
  Payload ID: 2400
  Gene Symbol: CSNK2B
  Gene Name: casein kinase 2, beta polypeptide
  ENSP ID: ENSP00000478586
MSSSEEVSWISWFCGLRGNEFFCEVDEDYIQDKFNLTGLNEQVPHYRQALDMILDLEPDEELEDNPNQSDLIEQAAEMLYGLIHALPLSDSQIQWFYQALNLSLPLPNFHAGTEPDGLDPMVTLSLNLGLSFAELCRMYLFLNSSGLLVLPQAGLLTPHPS

SEQ ID NO: 12172 - protein, 304 aa, Homo sapiens; identical to SEQ ID NO: 12170
  Payload ID: 2400
  Gene Symbol: CSNK2B
  Gene Name: casein kinase 2, beta polypeptide
  ENSP ID: ENSP00000478717

SEQ ID NO: 12173 - protein, 161 aa, Homo sapiens; identical to SEQ ID NO: 12169
  Payload ID: 2400
  Gene Symbol: CSNK2B
  Gene Name: casein kinase 2, beta polypeptide
  ENSP ID: ENSP00000478919

SEQ ID NO: 12174 - protein, 304 aa, Homo sapiens
  Payload ID: 2400
  Gene Symbol: CSNK2B
  Gene Name: casein kinase 2, beta polypeptide
  ENSP ID: ENSP00000480237
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 12175 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000480787

SEQ ID NO: 12176 - protein, 161 aa, Homo sapiens; identical to SEQ ID NO: 12171
  Payload ID: 2400
  Gene Symbol: CSNK2B
  Gene Name: casein kinase 2, beta polypeptide
  ENSP ID: ENSP00000483317

SEQ ID NO: 12177 - protein, 304 aa, Homo sapiens; identical to SEQ ID NO: 12174
  Payload ID: 2400
  Gene Symbol: CSNK2B
  Gene Name: casein kinase 2, beta polypeptide
  ENSP ID: ENSP00000483938

SEQ ID NO: 12178 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000484115

SEQ ID NO: 12179 - protein, 228 aa, Homo sapiens; identical to SEQ ID NO: 12141
  Payload ID: 2400
  Gene Symbol: CSNK2B
  Gene Name: casein kinase 2, beta polypeptide
  ENSP ID: ENSP00000484705

SEQ ID NO: 12180 - protein, 633 aa, Homo sapiens
  Payload ID: 2401
  Gene Symbol: CLPX
  Gene Name: caseinolytic mitochondrial matrix peptidase chaperone subunit
  Uniprot ID: O76031
  ENSP ID: ENSP00000300107
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 12181 - protein, 130 aa, Homo sapiens
  Payload ID: 2401
  Gene Symbol: CLPX
  Gene Name: caseinolytic mitochondrial matrix peptidase chaperone subunit
  ENSP ID: ENSP00000452611
MSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQK

SEQ ID NO: 12182 - protein, 268 aa, Homo sapiens
  Payload ID: 2401
  Gene Symbol: CLPX
  Gene Name: caseinolytic mitochondrial matrix peptidase chaperone subunit
  ENSP ID: ENSP00000453461
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVKLCWHKP

SEQ ID NO: 12183 - protein, 277 aa, Homo sapiens
  Payload ID: 2402
  Gene Symbol: CLPP
  Gene Name: caseinolytic mitochondrial matrix peptidase proteolytic subunit
  Uniprot ID: Q16740
  ENSP ID: ENSP00000245816
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 12184 - protein, 56 aa, Homo sapiens
  Payload ID: 2402
  Gene Symbol: CLPP
  Gene Name: caseinolytic mitochondrial matrix peptidase proteolytic subunit
  ENSP ID: ENSP00000469124
MGPIDDSVASLVIAQLLFLQSESNKKPIHMYINSPGPSHRHCHPGRGDHEAQEAAL

SEQ ID NO: 12185 - protein, 160 aa, Homo sapiens
  Payload ID: 2402
  Gene Symbol: CLPP
  Gene Name: caseinolytic mitochondrial matrix peptidase proteolytic subunit
  ENSP ID: ENSP00000470098
SFPSWWSRRVAASAPMTSTRGCCGSASCASWARSMTALPALLSHSSSSCNPRATRSPSTCGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESA

SEQ ID NO: 12186 - protein, 190 aa, Homo sapiens
  Payload ID: 2402
  Gene Symbol: CLPP
  Gene Name: caseinolytic mitochondrial matrix peptidase proteolytic subunit
  ENSP ID: ENSP00000472227
MGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 12187 - protein, 1431 aa, Homo sapiens
  Payload ID: 2403
  Gene Symbol: CASKIN1
  Gene Name: CASK interacting protein 1
  Uniprot ID: Q8WXD9
  ENSP ID: ENSP00000345436
MGKEQELVQAVKAEDVGTAQRLLQRPRPGKAKLLGSTKKINVNFQDPDGFSALHHAALNGNTELISLLLEAQAAVDIKDNKGMRPLHYAAWQGRKEPMKLVLKAGSAVNIPSDEGHIPLHLAAQHGHYDVSEMLLQHQSNPCMVDNSGKTPLDLACEFGRVGVVQLLLSSNMCAALLEPRPGDATDPNGTSPLHLAAKNGHIDIIRLLLQAGIDINRQTKSGTALHEAALCGKTEVVRLLLDSGINAHVRNTYSQTALDIVHQFTTSQASREIKQLLREASAALQVRATKDYCNNYDLTSLNVKAGDIITVLEQHPDGRWKGCIHDNRTGNDRVGYFPSSLGEAIVKRAGSRAGTEPSLPQGSSSSGPSAPPEEIWVLRKPFAGGDRSGSISGMAGGRGSGGHALHAGSEGVKLLATVLSQKSVSESGPGDSPAKPPEGSAGVARSQPPVAHAGQVYGEQPPKKLEPASEGKSSEAVSQWLTAFQLQLYAPNFISAGYDLPTISRMTPEDLTAIGVTKPGHRKKIAAEISGLSIPDWLPEHKPANLAVWLSMIGLAQYYKVLVDNGYENIDFITDITWEDLQEIGITKLGHQKKLMLAVRKLAELQKAEYAKYEGGPLRRKAPQSLEVMAIESPPPPEPTPADCQSPKMTTFQDSELSDELQAAMTGPAEVGPTTEKPSSHLPPTPRATTRQDSSLGGRARHMSSSQELLGDGPPGPSSPMSRSQEYLLDEGPAPGTPPREARPGRHGHSIKRASVPPVPGKPRQVLPPGTSHFTPPQTPTKTRPGSPQALGGPHGPAPATAKVKPTPQLLPPTERPMSPRSLPQSPTHRGFAYVLPQPVEGEVGPAAPGPAPPPVPTAVPTLCLPPEADAEPGRPKKRAHSLNRYAASDSEPERDELLVPAAAGPYATVQRRVGRSHSVRAPAGADKNVNRSQSFAVRPRKKGPPPPPPKRSSSALASANLADEPVPDAEPEDGLLGVRAQCRRASDLAGSVDTGSAGSVKSIAAMLELSSIGGGGRAARRPPEGHPTPRPASPEPGRVATVLASVKHKEAIGPGGEVVNRRRTLSGPVTGLLATARRGPGESADPGPFVEDGTGRQRPRGPSKGEAGVEGPPLAKVEASATLKRRIRAKQNQQENVKFILTESDTVKRRPKAKEREAGPEPPPPLSVYHNGTGTVRRRPASEQAGPPELPPPPPPAEPPPTDLAHLPPLPPPEGEARKPAKPPVSPKPVLTQPVPKLQGSPTPTSKKVPLPGPGSPEVKRAHGTPPPVSPKPPPPPTAPKPVKAVAGLPSGSAGPSPAPSPARQPPAALAKPPGTPPSLGASPAKPPSPGAPALHVPAKPPRAAAAAAAAAAAPPAPPEGASPGDSARQKLEETSACLAAALQAVEEKIRQEDAQGPRDSAAEKSTGSILDDIGSMFDDLADQLDAMLE

SEQ ID NO: 12188 - protein, 1202 aa, Homo sapiens
  Payload ID: 2404
  Gene Symbol: CASKIN2
  Gene Name: CASK interacting protein 2
  Uniprot ID: Q8WXE0
  ENSP ID: ENSP00000325355
MGREQDLILAVKNGDVTGVQKLVAKVKATKTKLLGSTKRLNVNYQDADGFSALHHAALGGSLELIALLLEAQATVDIKDSNGMRPLHYAAWQGRLEPVRLLLRASAAVNAASLDGQIPLHLAAQYGHYEVSEMLLQHQSNPCLVNKAKKTPLDLACEFGRLKVAQLLLNSHLCVALLEGEAKDPCDPNYTTPLHLAAKNGHREVIRQLLRAGIEINRQTKTGTALHEAALYGKTEVVRLLLEGGVDVNIRNTYNQTALDIVNQFTTSQASREIKQLLREASGILKVRALKDFWNLHDPTALNVRAGDVITVLEQHPDGRWKGHIHESQRGTDRIGYFPPGIVEVVSKRVGIPAARLPSAPTPLRPGFSRTPQPPAEEPPHPLTYSQLPRVGLSPDSPAGDRNSVGSEGSVGSIRSAGSGQSSEGTNGHGPGLLIENAQPLPSAGEDQVLPGLHPPSLADNLSHRPLANCRSGEQIFTQDVRPEQLLEGKDAQAIHNWLSEFQLEGYTAHFLQAGYDVPTISRMTPEDLTAIGVTKPGHRKKIASEIAQLSIAEWLPSYIPTDLLEWLCALGLPQYHKQLVSSGYDSMGLVADLTWEELQEIGVNKLGHQKKLMLGVKRLAELRRGLLQGEALSEGGRRLAKGPELMAIEGLENGEGPATAGPRLLTFQGSELSPELQAAMAGGGPEPLPLPPARSPSQESIGARSRGSGHSQEQPAPQPSGGDPSPPQERNLPEGTERPPKLCSSLPGQGPPPYVFMYPQGSPSSPAPGPPPGAPWAFSYLAGPPATPPDPPRPKRRSHSLSRPGPTEGDAEGEAEGPVGSTLGSYATLTRRPGRSALVRTSPSVTPTPARGTPRSQSFALRARRKGPPPPPPKRLSSVSGPSPEPPPLDESPGPKEGATGPRRRTLSEPAGPSEPPGPPAPAGPASDTEEEEPGPEGTPPSRGSSGEGLPFAEEGNLTIKQRPKPAGPPPRETPVPPGLDFNLTESDTVKRRPKCREREPLQTALLAFGVASATPGPAAPLPSPTPGESPPASSLPQPEPSSLPAQGVPTPLAPSPAMQPPVPPCPGPGLESSAASRWNGETEPPAAPAALLKVPGAGTAPKPVSVACTQLAFSGPKLAPRLGPRPVPPPRPESTGTVGPGQAQQRLEQTSSSLAAALRAAEKSIGTKEQEGTPSASTKHILDDISTMFDALADQLDAMLD

SEQ ID NO: 12189 - protein, 1120 aa, Homo sapiens
  Payload ID: 2404
  Gene Symbol: CASKIN2
  Gene Name: CASK interacting protein 2
  Uniprot ID: Q8WXE0
  ENSP ID: ENSP00000406963
MRPLHYAAWQGRLEPVRLLLRASAAVNAASLDGQIPLHLAAQYGHYEVSEMLLQHQSNPCLVNKAKKTPLDLACEFGRLKVAQLLLNSHLCVALLEGEAKDPCDPNYTTPLHLAAKNGHREVIRQLLRAGIEINRQTKTGTALHEAALYGKTEVVRLLLEGGVDVNIRNTYNQTALDIVNQFTTSQASREIKQLLREASGILKVRALKDFWNLHDPTALNVRAGDVITVLEQHPDGRWKGHIHESQRGTDRIGYFPPGIVEVVSKRVGIPAARLPSAPTPLRPGFSRTPQPPAEEPPHPLTYSQLPRVGLSPDSPAGDRNSVGSEGSVGSIRSAGSGQSSEGTNGHGPGLLIENAQPLPSAGEDQVLPGLHPPSLADNLSHRPLANCRSGEQIFTQDVRPEQLLEGKDAQAIHNWLSEFQLEGYTAHFLQAGYDVPTISRMTPEDLTAIGVTKPGHRKKIASEIAQLSIAEWLPSYIPTDLLEWLCALGLPQYHKQLVSSGYDSMGLVADLTWEELQEIGVNKLGHQKKLMLGVKRLAELRRGLLQGEALSEGGRRLAKGPELMAIEGLENGEGPATAGPRLLTFQGSELSPELQAAMAGGGPEPLPLPPARSPSQESIGARSRGSGHSQEQPAPQPSGGDPSPPQERNLPEGTERPPKLCSSLPGQGPPPYVFMYPQGSPSSPAPGPPPGAPWAFSYLAGPPATPPDPPRPKRRSHSLSRPGPTEGDAEGEAEGPVGSTLGSYATLTRRPGRSALVRTSPSVTPTPARGTPRSQSFALRARRKGPPPPPPKRLSSVSGPSPEPPPLDESPGPKEGATGPRRRTLSEPAGPSEPPGPPAPAGPASDTEEEEPGPEGTPPSRGSSGEGLPFAEEGNLTIKQRPKPAGPPPRETPVPPGLDFNLTESDTVKRRPKCREREPLQTALLAFGVASATPGPAAPLPSPTPGESPPASSLPQPEPSSLPAQGVPTPLAPSPAMQPPVPPCPGPGLESSAASRWNGETEPPAAPAALLKVPGAGTAPKPVSVACTQLAFSGPKLAPRLGPRPVPPPRPESTGTVGPGQAQQRLEQTSSSLAAALRAAEKSIGTKEQEGTPSASTKHILDDISTMFDALADQLDAMLD

SEQ ID NO: 12190 - protein, 25 aa, Homo sapiens
  Payload ID: 2404
  Gene Symbol: CASKIN2
  Gene Name: CASK interacting protein 2
  ENSP ID: ENSP00000463211
MGREQDLILAVKNGDVTGVQKLVAK

SEQ ID NO: 12191 - protein, 323 aa, Homo sapiens
  Payload ID: 2404
  Gene Symbol: CASKIN2
  Gene Name: CASK interacting protein 2
  ENSP ID: ENSP00000464300
MGREQDLILAVKNGDVTGVQKLVAKVKATKTKLLGSTKRLNVNYQDADGFSALHHAALGGSLELIALLLEAQATVDIKDSNGMRPLHYAAWQGRLEPVRLLLRASAAVNAASLDGQIPLHLAAQYGHYEVSEMLLQHQSNPCLVNKAKKTPLDLACEFGRLKVAQLLLNSHLCVALLEGEAKDPCDPNYTTPLHLAAKNGHREVIRQLLRAGIEINRQTKTGTALHEAALYGKTEVVRLLLEGGVDVNIRNTYNQTALDIVNQFTTSQASREIKQLLREASGILKVRALKDFWNLHDPTALNVRAGDVITVRDPKQAFLCKYK

SEQ ID NO: 12192 - protein, 199 aa, Homo sapiens
  Payload ID: 2405
  Gene Symbol: CRADD
  Gene Name: CASP2 and RIPK1 domain containing adaptor with death domain
  Uniprot ID: P78560
  ENSP ID: ENSP00000327647
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 12193 - protein, 199 aa, Homo sapiens; identical to SEQ ID NO: 12192
  Payload ID: 2405
  Gene Symbol: CRADD
  Gene Name: CASP2 and RIPK1 domain containing adaptor with death domain
  Uniprot ID: P78560
  ENSP ID: ENSP00000439068

SEQ ID NO: 12194 - protein, 103 aa, Homo sapiens
  Payload ID: 2405
  Gene Symbol: CRADD
  Gene Name: CASP2 and RIPK1 domain containing adaptor with death domain
  Uniprot ID: P78560
  ENSP ID: ENSP00000448425
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGCWP

SEQ ID NO: 12195 - protein, 121 aa, Homo sapiens
  Payload ID: 2405
  Gene Symbol: CRADD
  Gene Name: CASP2 and RIPK1 domain containing adaptor with death domain
  ENSP ID: ENSP00000448685
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAEMRKLRPKDSVTCLASQLTWRF

SEQ ID NO: 12196 - protein, 130 aa, Homo sapiens
  Payload ID: 2405
  Gene Symbol: CRADD
  Gene Name: CASP2 and RIPK1 domain containing adaptor with death domain
  ENSP ID: ENSP00000449570
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGLEEKGRTGRRMGWGAGEEKGQKCQTVGMRT

SEQ ID NO: 12197 - protein, 115 aa, Homo sapiens
  Payload ID: 2405
  Gene Symbol: CRADD
  Gene Name: CASP2 and RIPK1 domain containing adaptor with death domain
  ENSP ID: ENSP00000449664
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAVAIIRLPRELSLPTLL

SEQ ID NO: 12198 - protein, 480 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000312455
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 12199 - protein, 321 aa, Homo sapiens
  Payload ID: 2406
  Gene Symbol: CFLAR
  Gene Name: CASP8 and FADD-like apoptosis regulator
  ENSP ID: ENSP00000339326
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFREEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQER

SEQ ID NO: 12200 - protein, 221 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000339335
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRMITPYAHCPDLKILGNCSM

SEQ ID NO: 12201 - protein, 292 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000342809
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETGWSAMAQSQLTAISTSQVQAILLPQPPE

SEQ ID NO: 12202 - protein, 445 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000345807
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 12203 - protein, 250 aa, Homo sapiens
  Payload ID: 2406
  Gene Symbol: CFLAR
  Gene Name: CASP8 and FADD-like apoptosis regulator
  ENSP ID: ENSP00000378580
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSGGWNGTWMTKASFSLWLEIASLYILHIPDLPTPLPCIFMISAKCCQAVLNISVFKKESGICTGWQSYGHSGVLHVC

SEQ ID NO: 12204 - protein, 64 aa, Homo sapiens
  Payload ID: 2406
  Gene Symbol: CFLAR
  Gene Name: CASP8 and FADD-like apoptosis regulator
  ENSP ID: ENSP00000391029
MSAEVIHQVEEALDTDEKEMLLFLCRDVAIDVVPPNVRDLLDILRERGKLSVGDLAELLYRVRR

SEQ ID NO: 12205 - protein, 243 aa, Homo sapiens
  Payload ID: 2406
  Gene Symbol: CFLAR
  Gene Name: CASP8 and FADD-like apoptosis regulator
  ENSP ID: ENSP00000398551
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRAGVQWRDLGSPQPPPPGFKRFSHLSLPSSWDYRNVPPRPAP

SEQ ID NO: 12206 - protein, 480 aa, Homo sapiens; identical to SEQ ID NO: 12198
  Payload ID: 2406
  Gene Symbol: CFLAR
  Gene Name: CASP8 and FADD-like apoptosis regulator
  Uniprot ID: O15519
  ENSP ID: ENSP00000399420

SEQ ID NO: 12207 - protein, 221 aa, Homo sapiens; identical to SEQ ID NO: 12200
  Payload ID: 2406
  Gene Symbol: CFLAR
  Gene Name: CASP8 and FADD-like apoptosis regulator
  Uniprot ID: O15519
  ENSP ID: ENSP00000406775

SEQ ID NO: 12208 - protein, 62 aa, Homo sapiens
  Payload ID: 2406
  Gene Symbol: CFLAR
  Gene Name: CASP8 and FADD-like apoptosis regulator
  ENSP ID: ENSP00000409570
MSAEVIHQVEEALDTDEKEMLLFLCRDVAIDVVPPNVRDLLDILRERGKLSVGDLAELLYRV

SEQ ID NO: 12209 - protein, 462 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000411535
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 12210 - protein, 129 aa, Homo sapiens
  Payload ID: 2406
  Gene Symbol: CFLAR
  Gene Name: CASP8 and FADD-like apoptosis regulator
  ENSP ID: ENSP00000411897
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEK

SEQ ID NO: 12211 - protein, 118 aa, Homo sapiens
  Payload ID: 2406
  Gene Symbol: CFLAR
  Gene Name: CASP8 and FADD-like apoptosis regulator
  ENSP ID: ENSP00000412882
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKD

SEQ ID NO: 12212 - protein, 384 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000413270
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 12213 - protein, 117 aa, Homo sapiens
  Payload ID: 2406
  Gene Symbol: CFLAR
  Gene Name: CASP8 and FADD-like apoptosis regulator
  ENSP ID: ENSP00000469608
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRVSLEKTYGIPA

SEQ ID NO: 12214 - protein, 168 aa, Homo sapiens
  Payload ID: 2406
  Gene Symbol: CFLAR
  Gene Name: CASP8 and FADD-like apoptosis regulator
  ENSP ID: ENSP00000469917
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNET

SEQ ID NO: 12215 - protein, 117 aa, Homo sapiens
  Payload ID: 2406
  Gene Symbol: CFLAR
  Gene Name: CASP8 and FADD-like apoptosis regulator
  ENSP ID: ENSP00000471749
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRMITPYAHCPDL

SEQ ID NO: 12216 - protein, 366 aa, Homo sapiens
  Payload ID: 2406
  Gene Symbol: CFLAR
  Gene Name: CASP8 and FADD-like apoptosis regulator
  Uniprot ID: O15519
  ENSP ID: ENSP00000471805
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 12217 - protein, 88 aa, Homo sapiens
  Payload ID: 2407
  Gene Symbol: CASP1
  Gene Name: caspase 1, apoptosis-related cysteine peptidase
  Uniprot ID: P29466
  ENSP ID: ENSP00000344132
MADKVLKEKRKLFIRSMGEDNVSWRHPTMGSVFIGRLIEHMQEYACSCDVEEIFRKVRFSFEQPDGRAQMPTTERVTLTRCFYLFPGH

SEQ ID NO: 12218 - protein, 263 aa, Homo sapiens
  Payload ID: 2407
  Gene Symbol: CASP1
  Gene Name: caspase 1, apoptosis-related cysteine peptidase
  Uniprot ID: P29466
  ENSP ID: ENSP00000403260
MADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDNVSWRHPTMGSVFIGRLIEHMQEYACSCDVEEIFRKVRFSFEQPDGRAQMPTTERVTLTRCFYLFPGH

SEQ ID NO: 12219 - protein, 404 aa, Homo sapiens
  Payload ID: 2407
  Gene Symbol: CASP1
  Gene Name: caspase 1, apoptosis-related cysteine peptidase
  Uniprot ID: P29466
  ENSP ID: ENSP00000410076
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 12220 - protein, 110 aa, Homo sapiens
  Payload ID: 2407
  Gene Symbol: CASP1
  Gene Name: caspase 1, apoptosis-related cysteine peptidase
  ENSP ID: ENSP00000431947
MADKVLKEKRKLFIRSMGEGTINGLLDELLQTRVLNKEEMEKVKRENATVMDKTRALIDSVIPKGAQACQICITYICEEDSYLAGTLGLSADLSNNGQVKPHTSCSHYLQ

SEQ ID NO: 12221 - protein, 367 aa, Homo sapiens
  Payload ID: 2407
  Gene Symbol: CASP1
  Gene Name: caspase 1, apoptosis-related cysteine peptidase
  ENSP ID: ENSP00000432340
MGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 12222 - protein, 404 aa, Homo sapiens; identical to SEQ ID NO: 12219
  Payload ID: 2407
  Gene Symbol: CASP1
  Gene Name: caspase 1, apoptosis-related cysteine peptidase
  Uniprot ID: P29466
  ENSP ID: ENSP00000433138

SEQ ID NO: 12223 - protein, 311 aa, Homo sapiens
  Payload ID: 2407
  Gene Symbol: CASP1
  Gene Name: caspase 1, apoptosis-related cysteine peptidase
  Uniprot ID: P29466
  ENSP ID: ENSP00000434250
MADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 12224 - protein, 301 aa, Homo sapiens
  Payload ID: 2407
  Gene Symbol: CASP1
  Gene Name: caspase 1, apoptosis-related cysteine peptidase
  ENSP ID: ENSP00000434259
MEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPGKSQS

SEQ ID NO: 12225 - protein, 88 aa, Homo sapiens; identical to SEQ ID NO: 12217
  Payload ID: 2407
  Gene Symbol: CASP1
  Gene Name: caspase 1, apoptosis-related cysteine peptidase
  Uniprot ID: P29466
  ENSP ID: ENSP00000434303

SEQ ID NO: 12226 - protein, 383 aa, Homo sapiens
  Payload ID: 2407
  Gene Symbol: CASP1
  Gene Name: caspase 1, apoptosis-related cysteine peptidase
  Uniprot ID: P29466
  ENSP ID: ENSP00000434779
MADKVLKEKRKLFIRSMGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 12227 - protein, 236 aa, Homo sapiens
  Payload ID: 2407
  Gene Symbol: CASP1
  Gene Name: caspase 1, apoptosis-related cysteine peptidase
  ENSP ID: ENSP00000435536
IYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKEVKRSFCKGFWNYVC

SEQ ID NO: 12228 - protein, 263 aa, Homo sapiens; identical to SEQ ID NO: 12218
  Payload ID: 2407
  Gene Symbol: CASP1
  Gene Name: caspase 1, apoptosis-related cysteine peptidase
  Uniprot ID: P29466
  ENSP ID: ENSP00000436875

SEQ ID NO: 12229 - protein, 479 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000237865
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 12230 - protein, 521 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000272879
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 12231 - protein, 522 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000286186
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 12232 - protein, 455 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000314599
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 12233 - protein, 273 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000353250
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNEGSCVQDESEPQRPLCHCQQPQLYLPEGQTRNP

SEQ ID NO: 12234 - protein, 247 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000363781
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPEGVFVFLNEGDRGNSPDDL

SEQ ID NO: 12235 - protein, 478 aa, Homo sapiens
  Payload ID: 2408
  Gene Symbol: CASP10
  Gene Name: caspase 10, apoptosis-related cysteine peptidase
  Uniprot ID: Q92851
  ENSP ID: ENSP00000396835
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 12236 - protein, 118 aa, Homo sapiens
  Payload ID: 2408
  Gene Symbol: CASP10
  Gene Name: caspase 10, apoptosis-related cysteine peptidase
  ENSP ID: ENSP00000401914
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRPP

SEQ ID NO: 12237 - protein, 168 aa, Homo sapiens
  Payload ID: 2409
  Gene Symbol: CASP12
  Gene Name: caspase 12 (gene/pseudogene)
  Uniprot ID: Q6UXS9
  ENSP ID: ENSP00000421408
MADEKPSNGVLVHMVKLLIKTFLDGIFDDLMENNVLNTDEIHLIGKCLKFVVSNAENLVDDITETAQIAGKIFREHLWNSKKQLSSAFLEIQGAQPSGKLKLCPHAHFHELKTKRADEIYPVMEKERRTCLASTSATKNSTIFIIEMVLNLTFWGCEIYLKTLDTQWL

SEQ ID NO: 12238 - protein, 225 aa, Homo sapiens
  Payload ID: 2409
  Gene Symbol: CASP12
  Gene Name: caspase 12 (gene/pseudogene)
  ENSP ID: ENSP00000421815
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHVQHSFETPNILTQLPTIERLSMTRYFYLFPGN

SEQ ID NO: 12239 - protein, 223 aa, Homo sapiens
  Payload ID: 2409
  Gene Symbol: CASP12
  Gene Name: caspase 12 (gene/pseudogene)
  ENSP ID: ENSP00000423899
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHIMFLGDMKQMALSSFPKLSTTSESILGVII

SEQ ID NO: 12240 - protein, 294 aa, Homo sapiens
  Payload ID: 2409
  Gene Symbol: CASP12
  Gene Name: caspase 12 (gene/pseudogene)
  ENSP ID: ENSP00000423970
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKMVLGLFGSPLTVEKPVQILMVGSCKVTSVMMLLQRLMWKRTSLLSNLPHHVQHSFETPNILTQLPTIERLSMTRYFYLFPGN

SEQ ID NO: 12241 - protein, 340 aa, Homo sapiens
  Payload ID: 2409
  Gene Symbol: CASP12
  Gene Name: caspase 12 (gene/pseudogene)
  Uniprot ID: Q6UXS9
  ENSP ID: ENSP00000424038
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 12242 - protein, 168 aa, Homo sapiens; identical to SEQ ID NO: 12237
  Payload ID: 2409
  Gene Symbol: CASP12
  Gene Name: caspase 12 (gene/pseudogene)
  Uniprot ID: Q6UXS9
  ENSP ID: ENSP00000424963

SEQ ID NO: 12243 - protein, 276 aa, Homo sapiens
  Payload ID: 2409
  Gene Symbol: CASP12
  Gene Name: caspase 12 (gene/pseudogene)
  ENSP ID: ENSP00000425652
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPRSTFI

SEQ ID NO: 12244 - protein, 139 aa, Homo sapiens
  Payload ID: 2409
  Gene Symbol: CASP12
  Gene Name: caspase 12 (gene/pseudogene)
  ENSP ID: ENSP00000426427
MADISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHIMFLGDMKQMALSSFPKLSTTSESILGVII

SEQ ID NO: 12245 - protein, 256 aa, Homo sapiens
  Payload ID: 2409
  Gene Symbol: CASP12
  Gene Name: caspase 12 (gene/pseudogene)
  Uniprot ID: Q6UXS9
  ENSP ID: ENSP00000426566
MADISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 12246 - protein, 340 aa, Homo sapiens; identical to SEQ ID NO: 12241
  Payload ID: 2409
  Gene Symbol: CASP12
  Gene Name: caspase 12 (gene/pseudogene)
  Uniprot ID: Q6UXS9
  ENSP ID: ENSP00000427128

SEQ ID NO: 12247 - protein, 141 aa, Homo sapiens
  Payload ID: 2409
  Gene Symbol: CASP12
  Gene Name: caspase 12 (gene/pseudogene)
  ENSP ID: ENSP00000427437
MADISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHVQHSFETPNILTQLPTIERLSMTRYFYLFPGN

SEQ ID NO: 12248 - protein, 340 aa, Homo sapiens; identical to SEQ ID NO: 12241
  Payload ID: 2409
  Gene Symbol: CASP12
  Gene Name: caspase 12 (gene/pseudogene)
  ENSP ID: ENSP00000482745

SEQ ID NO: 12249 - protein, 242 aa, Homo sapiens
  Payload ID: 2410
  Gene Symbol: CASP14
  Gene Name: caspase 14, apoptosis-related cysteine peptidase
  Uniprot ID: P31944
  ENSP ID: ENSP00000393417
MSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 12250 - protein, 452 aa, Homo sapiens
  Payload ID: 2411
  Gene Symbol: CASP2
  Gene Name: caspase 2, apoptosis-related cysteine peptidase
  Uniprot ID: P42575
  ENSP ID: ENSP00000312664
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 12251 - protein, 108 aa, Homo sapiens
  Payload ID: 2411
  Gene Symbol: CASP2
  Gene Name: caspase 2, apoptosis-related cysteine peptidase
  ENSP ID: ENSP00000340030
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 12252 - protein, 171 aa, Homo sapiens
  Payload ID: 2411
  Gene Symbol: CASP2
  Gene Name: caspase 2, apoptosis-related cysteine peptidase
  ENSP ID: ENSP00000376656
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTEIGSCSVTQAGMQ

SEQ ID NO: 12253 - protein, 108 aa, Homo sapiens; identical to SEQ ID NO: 12251
  Payload ID: 2411
  Gene Symbol: CASP2
  Gene Name: caspase 2, apoptosis-related cysteine peptidase
  ENSP ID: ENSP00000481929

SEQ ID NO: 12254 - protein, 277 aa, Homo sapiens
  Payload ID: 2412
  Gene Symbol: CASP3
  Gene Name: caspase 3, apoptosis-related cysteine peptidase
  Uniprot ID: P42574
  ENSP ID: ENSP00000311032
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 12255 - protein, 182 aa, Homo sapiens
  Payload ID: 2412
  Gene Symbol: CASP3
  Gene Name: caspase 3, apoptosis-related cysteine peptidase
  ENSP ID: ENSP00000377210
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQVIILGEIQRMAPGSSSRFVPC

SEQ ID NO: 12256 - protein, 182 aa, Homo sapiens; identical to SEQ ID NO: 12255
  Payload ID: 2412
  Gene Symbol: CASP3
  Gene Name: caspase 3, apoptosis-related cysteine peptidase
  ENSP ID: ENSP00000377213

SEQ ID NO: 12257 - protein, 117 aa, Homo sapiens
  Payload ID: 2412
  Gene Symbol: CASP3
  Gene Name: caspase 3, apoptosis-related cysteine peptidase
  ENSP ID: ENSP00000407142
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCV

SEQ ID NO: 12258 - protein, 182 aa, Homo sapiens; identical to SEQ ID NO: 12255
  Payload ID: 2412
  Gene Symbol: CASP3
  Gene Name: caspase 3, apoptosis-related cysteine peptidase
  ENSP ID: ENSP00000428372

SEQ ID NO: 12259 - protein, 277 aa, Homo sapiens; identical to SEQ ID NO: 12254
  Payload ID: 2412
  Gene Symbol: CASP3
  Gene Name: caspase 3, apoptosis-related cysteine peptidase
  Uniprot ID: P42574
  ENSP ID: ENSP00000428929

SEQ ID NO: 12260 - protein, 156 aa, Homo sapiens
  Payload ID: 2412
  Gene Symbol: CASP3
  Gene Name: caspase 3, apoptosis-related cysteine peptidase
  ENSP ID: ENSP00000478339
MSDALIKVSMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKNNKLFQRGSL

SEQ ID NO: 12261 - protein, 321 aa, Homo sapiens
  Payload ID: 2413
  Gene Symbol: CASP4
  Gene Name: caspase 4, apoptosis-related cysteine peptidase
  Uniprot ID: P49662
  ENSP ID: ENSP00000376857
MADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 12262 - protein, 377 aa, Homo sapiens
  Payload ID: 2413
  Gene Symbol: CASP4
  Gene Name: caspase 4, apoptosis-related cysteine peptidase
  Uniprot ID: P49662
  ENSP ID: ENSP00000388566
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 12263 - protein, 147 aa, Homo sapiens
  Payload ID: 2413
  Gene Symbol: CASP4
  Gene Name: caspase 4, apoptosis-related cysteine peptidase
  ENSP ID: ENSP00000401673
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFD

SEQ ID NO: 12264 - protein, 72 aa, Homo sapiens
  Payload ID: 2413
  Gene Symbol: CASP4
  Gene Name: caspase 4, apoptosis-related cysteine peptidase
  ENSP ID: ENSP00000432879
  MOD_RES (1)..(1): Any amino acid
XNVSWRDSTMGSIFITQLITCFQKYSWCCHLEEVFRKEATSSPALLNQLQGAPSLVQLAYLTFCISIKVKTN

SEQ ID NO: 12265 - protein, 330 aa, Homo sapiens
  Payload ID: 2413
  Gene Symbol: CASP4
  Gene Name: caspase 4, apoptosis-related cysteine peptidase
  ENSP ID: ENSP00000482808
MLKLKTKFGSWQTLCKRSNVWQDKCFFKPFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 12266 - protein, 434 aa, Homo sapiens
  Payload ID: 2414
  Gene Symbol: CASP5
  Gene Name: caspase 5, apoptosis-related cysteine peptidase
  Uniprot ID: P51878
  ENSP ID: ENSP00000260315
MAEDSGKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 12267 - protein, 447 aa, Homo sapiens
  Payload ID: 2414
  Gene Symbol: CASP5
  Gene Name: caspase 5, apoptosis-related cysteine peptidase
  Uniprot ID: P51878
  ENSP ID: ENSP00000376849
MAAVPRVEGVFIFLIEDSGKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 12268 - protein, 376 aa, Homo sapiens
  Payload ID: 2414
  Gene Symbol: CASP5
  Gene Name: caspase 5, apoptosis-related cysteine peptidase
  Uniprot ID: P51878
  ENSP ID: ENSP00000388365
MAEDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 12269 - protein, 117 aa, Homo sapiens
  Payload ID: 2414
  Gene Symbol: CASP5
  Gene Name: caspase 5, apoptosis-related cysteine peptidase
  ENSP ID: ENSP00000396053
  MOD_RES (1)..(1): Any amino acid
XKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 12270 - protein, 292 aa, Homo sapiens
  Payload ID: 2414
  Gene Symbol: CASP5
  Gene Name: caspase 5, apoptosis-related cysteine peptidase
  Uniprot ID: P51878
  ENSP ID: ENSP00000398130
MAALLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 12271 - protein, 108 aa, Homo sapiens
  Payload ID: 2414
  Gene Symbol: CASP5
  Gene Name: caspase 5, apoptosis-related cysteine peptidase
  Uniprot ID: P51878
  ENSP ID: ENSP00000408455
MAEDNHKKKTVKMLEYLGKDVLHGVFNYLAKHDVLTLKEEEKKKYYDTKIEDKALILVDSLRKNRVAHQMFTQTLLNMDQKITSVKHLSNKKERGPQTPGSHHMQYKV

SEQ ID NO: 12272 - protein, 165 aa, Homo sapiens
  Payload ID: 2414
  Gene Symbol: CASP5
  Gene Name: caspase 5, apoptosis-related cysteine peptidase
  ENSP ID: ENSP00000415241
MFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDE

SEQ ID NO: 12273 - protein, 292 aa, Homo sapiens; identical to SEQ ID NO: 12270
  Payload ID: 2414
  Gene Symbol: CASP5
  Gene Name: caspase 5, apoptosis-related cysteine peptidase
  Uniprot ID: P51878
  ENSP ID: ENSP00000434471

SEQ ID NO: 12274 - protein, 447 aa, Homo sapiens; identical to SEQ ID NO: 12267
  Payload ID: 2414
  Gene Symbol: CASP5
  Gene Name: caspase 5, apoptosis-related cysteine peptidase
  Uniprot ID: P51878
  ENSP ID: ENSP00000436877

SEQ ID NO: 12275 - protein, 293 aa, Homo sapiens
  Payload ID: 2415
  Gene Symbol: CASP6
  Gene Name: caspase 6, apoptosis-related cysteine peptidase
  Uniprot ID: P55212
  ENSP ID: ENSP00000265164
MSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 12276 - protein, 204 aa, Homo sapiens
  Payload ID: 2415
  Gene Symbol: CASP6
  Gene Name: caspase 6, apoptosis-related cysteine peptidase
  Uniprot ID: P55212
  ENSP ID: ENSP00000285333
MSSASGLRRGHPAVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 12277 - protein, 80 aa, Homo sapiens
  Payload ID: 2415
  Gene Symbol: CASP6
  Gene Name: caspase 6, apoptosis-related cysteine peptidase
  ENSP ID: ENSP00000424080
MSSASGLRRGHPAGGEENMTETDAFYKREMFDPAEKYKMDHRRRGIALIFNHERFFWHLTLPERRGTCADRDNLTRSVNC

SEQ ID NO: 12278 - protein, 143 aa, Homo sapiens
  Payload ID: 2415
  Gene Symbol: CASP6
  Gene Name: caspase 6, apoptosis-related cysteine peptidase
  ENSP ID: ENSP00000427669
MTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQ

SEQ ID NO: 12279 - protein, 303 aa, Homo sapiens
  Payload ID: 2416
  Gene Symbol: CASP7
  Gene Name: caspase 7, apoptosis-related cysteine peptidase
  Uniprot ID: P55210
  ENSP ID: ENSP00000298701
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 12280 - protein, 303 aa, Homo sapiens; identical to SEQ ID NO: 12279
  Payload ID: 2416
  Gene Symbol: CASP7
  Gene Name: caspase 7, apoptosis-related cysteine peptidase
  Uniprot ID: P55210
  ENSP ID: ENSP00000358321

SEQ ID NO: 12281 - protein, 303 aa, Homo sapiens; identical to SEQ ID NO: 12279
  Payload ID: 2416
  Gene Symbol: CASP7
  Gene Name: caspase 7, apoptosis-related cysteine peptidase
  Uniprot ID: P55210
  ENSP ID: ENSP00000358324

SEQ ID NO: 12282 - protein, 388 aa, Homo sapiens
  Payload ID: 2416
  Gene Symbol: CASP7
  Gene Name: caspase 7, apoptosis-related cysteine peptidase
  ENSP ID: ENSP00000358327
MRAGTRVALGSSTPAERTTPSQGRCKPRPALPRAAPPSAAPRLLVSLSLKGPQTLAAERRRETVPVPAALPPWERWQMIRAVLKSRGLRIQQMKIQWMLSQTGPRLYRPSSAPDSGTLYFTSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 12283 - protein, 253 aa, Homo sapiens
  Payload ID: 2416
  Gene Symbol: CASP7
  Gene Name: caspase 7, apoptosis-related cysteine peptidase
  Uniprot ID: P55210
  ENSP ID: ENSP00000358337
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENMESCSVTQAGVQRRDLGRLQPPPPRLAEGPSLMMASRPTRGPSMTQMLILDTRSQWKLTSSSPIPRFQAITRGGAQEEAPGLCKPSAPSWRSTEKTWKSCRSSPG

SEQ ID NO: 12284 - protein, 278 aa, Homo sapiens
  Payload ID: 2416
  Gene Symbol: CASP7
  Gene Name: caspase 7, apoptosis-related cysteine peptidase
  Uniprot ID: P55210
  ENSP ID: ENSP00000398107
MQRGLFSDGDTSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 12285 - protein, 222 aa, Homo sapiens
  Payload ID: 2416
  Gene Symbol: CASP7
  Gene Name: caspase 7, apoptosis-related cysteine peptidase
  ENSP ID: ENSP00000400094
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFA

SEQ ID NO: 12286 - protein, 253 aa, Homo sapiens; identical to SEQ ID NO: 12283
  Payload ID: 2416
  Gene Symbol: CASP7
  Gene Name: caspase 7, apoptosis-related cysteine peptidase
  Uniprot ID: P55210
  ENSP ID: ENSP00000478285

SEQ ID NO: 12287 - protein, 336 aa, Homo sapiens
  Payload ID: 2416
  Gene Symbol: CASP7
  Gene Name: caspase 7, apoptosis-related cysteine peptidase
  Uniprot ID: P55210
  ENSP ID: ENSP00000478999
MDCVGWPPGRKWHLEKNTSCGGSSGICASYVTQMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 12288 - protein, 303 aa, Homo sapiens; identical to SEQ ID NO: 12279
  Payload ID: 2416
  Gene Symbol: CASP7
  Gene Name: caspase 7, apoptosis-related cysteine peptidase
  Uniprot ID: P55210
  ENSP ID: ENSP00000480584

SEQ ID NO: 12289 - protein, 1972 aa, Homo sapiens
  Payload ID: 2417
  Gene Symbol: CASP8AP2
  Gene Name: caspase 8 associated protein 2
  ENSP ID: ENSP00000478179
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRLSEFPHFRNNHKTARTFDTVKTKDLKSRSPHLDDCSKTDHRAKSDVSKDVHHSTSLPNLEKEGKPHSDKRSTSHLPTSVEKHCTNGVWSRSHYQVGEGSSNEDSRRGRKDIRHSQFNRGTERVRKDLSTGCGDGEPRILEASQRLQGHPEKYGKGEPKTESKSSKFKSNSDSDYKGERINSSWEKETPGERSHSRVDSQSDKKLERQSERSQNINRKEVKSQDKEERKVDQKPKSVVKDQDHWRRSERASLPHSKNEITFSHNSSKYHLEERRGWEDCKRDKSVNSHSFQDGRCPSSLSNSRTHKNIDSKEVDAMHQWENTPLKAERHRTEDKRKREQESKEENRHIRNEKRVPTEHLQKTNKETKKTTTDLKKQNEPKTDKGEVLDNGVSEGADNKELAMKAESGPNETKNKDLKLSFMKKLNLTLSPAKKQPVSQDNQHKITDIPKSSGVCDSESSMQVKTVAYVPSISEHILGEAAVSEHTMGETKSTLLEPKVALLAVTEPRIGISETNKEDENSLLVRSVDNTMHCEEPICGTETSFPSPMEIQQTESLFPSTGMKQTINNGRAAAPVVMDVLQTDVSQNFGLELDTKRNDNSDYCGISEGMEMKVALSTTVSETTESILQPSIEEADILPIMLSEDNNPKFEPSVIVTPLVESKSCHLEPCLPKETLDSSLQQTELMDHRMATGETNSVYHDDDNSVLSIDLNHLRPIPEAISPLNSPVRPVAKVLRNESPPQVPVYNNSHKDVFLPNSAHSTSKSQSDLNKENQKPIYKSDKCTEADTCKNSPLDELEEGEIRSDSETSKPQESFEKNSKRRVSADVRKSKTIPRRGKSTVCLDKDSRKTHVRIHQTNNKWNKRPDKSSRSSKTEKKDKVMSTSSLEKIVPIIAVPSSEQEIMHMLRMIRKHVRKNYMKFKAKFSLIQFHRIIESAILSFTSLIKHLNLHKISKSVTTLQKNLCDIIESKLKQVKKNGIVDRLFEQQLPDMKKKLWKFVDDQLDYLFAKLKKILVCDSKSFGRDSDEGKLEKTSKQNAQYSNSQKRSVDNSNRELLKEKLSKSEDPVHYKSLVGCKKSEENYQDQNNSSINTVKHDIKKNFNICFDNIKNSQSEERSLEVHCPSTPKSEKNEGSSIEDAQTSQHATLKPERSFEILTEQQASSLTFNLVSDAQMGEIFKSLLQGSDLLDSSVNCTEKSEWELKTPEKQLLETLKCESIPACTTEELVSGVASPCPKMISDDNWSLLSSEKGPSLSSGLSLPVHPDVLDESCMFEVSTNLPLSKDNVCSVEKSKPCVSSILLEDLAVSLTVPSPLKSDGHLSFLKPDMSSSSTPEEVISAHFSEDALLEEEDASEQDIHLALESDNSSSKSSCSSSWTSRSVAPGFQYHPNLPMHAVIMEKSNDHFIVKIRRATPSTSSGLKQSMMPDELLTSLPRHGKEADEGPEKEYISCQNTVFKSVEELENSNKNVDGSKSTHEEQSSMIQTQVPDIYEFLKDASDKMGHSDEVADECFKLHQVWETKVPESIEELPSMEEISHSVGEHLPNTYVDLTKDPVTETKNLGEFIEVTVLHIDQLGCSGGNLNQSAQILDNSLQADTVGAFIDLTQDASSEAKSEGNHPALAVEDLGCGVIQVDEDNCKEEKAQVANRPLKCIVEETYIDLTTESPSSCEVKKDELKSEPGSNCDNSELPGTLHNSHKKRRNISDLNHPHKKQRKETDLTNKEKTKKPTQDSCENTEAHQKKASKKKAPPVTKDPSSLKATPGIKDSSAALATSTSLSAKNVIKKKGEIIILWTRNDDREILLECQKRGPSFKTFAYLAAKLDKNPNQVTTQFLHL

SEQ ID NO: 12290 - protein, 361 aa, Homo sapiens
  Payload ID: 2417
  Gene Symbol: CASP8AP2
  Gene Name: caspase 8 associated protein 2
  ENSP ID: ENSP00000485346
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRLSEFPHFRNNHKTARTFDTVKTKDLKSRSPHLDDCSKTDHRAKSDVSKDVHHSTSLPNLEKEGKPHSDKRSTSHLPTSVEKHCTNGVWSRSHYQVGEGSSNEDSRRGRKDIRHSQFNRGTERVRKDLSTGCGDGEPRILEASQRLQGHPEKYGKGEPKTESKSSKFKSNSDSDYKGERINSSWEKETPGERSHSRVDSQSDKKLERQSERSQNINRKEVKSQ

SEQ ID NO: 12291 - protein, 361 aa, Homo sapiens; identical to SEQ ID NO: 12290
  Payload ID: 2417
  Gene Symbol: CASP8AP2
  Gene Name: caspase 8 associated protein 2
  ENSP ID: ENSP00000485349

SEQ ID NO: 12292 - protein, 395 aa, Homo sapiens
  Payload ID: 2418
  Gene Symbol: CASP8
  Gene Name: caspase 8, apoptosis-related cysteine peptidase
  Uniprot ID: Q14790
  ENSP ID: ENSP00000264274
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 12293 - protein, 496 aa, Homo sapiens
  Payload ID: 2418
  Gene Symbol: CASP8
  Gene Name: caspase 8, apoptosis-related cysteine peptidase
  Uniprot ID: Q14790
  ENSP ID: ENSP00000264275
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRFHFCRMSWAEANSQCQTQSVPFWRRVDHLLIRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 12294 - protein, 464 aa, Homo sapiens
  Payload ID: 2418
  Gene Symbol: CASP8
  Gene Name: caspase 8, apoptosis-related cysteine peptidase
  Uniprot ID: Q14790
  ENSP ID: ENSP00000325722
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 12295 - protein, 538 aa, Homo sapiens
  Payload ID: 2418
  Gene Symbol: CASP8
  Gene Name: caspase 8, apoptosis-related cysteine peptidase
  Uniprot ID: Q14790
  ENSP ID: ENSP00000351273
MEGGRRARVVIESKRNFFLGAFPTPFPAEHVELGRLGDSETAMVPGKGGADYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 12296 - protein, 235 aa, Homo sapiens
  Payload ID: 2418
  Gene Symbol: CASP8
  Gene Name: caspase 8, apoptosis-related cysteine peptidase
  Uniprot ID: Q14790
  ENSP ID: ENSP00000376087
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNDFGQSLPNEKQTSGILSDHQQSQFCKSTGESAQTSQH

SEQ ID NO: 12297 - protein, 464 aa, Homo sapiens; identical to SEQ ID NO: 12294
  Payload ID: 2418
  Gene Symbol: CASP8
  Gene Name: caspase 8, apoptosis-related cysteine peptidase
  Uniprot ID: Q14790
  ENSP ID: ENSP00000376091

SEQ ID NO: 12298 - protein, 278 aa, Homo sapiens [sequence omitted]

SEQ ID NO: 12299 - protein, 209 aa, Homo sapiens
  Payload ID: 2418
  Gene Symbol: CASP8
  Gene Name: caspase 8, apoptosis-related cysteine peptidase
  ENSP ID: ENSP00000388306
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKDFGQSLPNEKQTSGILSDHQQSQFCK

SEQ ID NO: 12300 - protein, 83 aa, Homo sapiens
  Payload ID: 2418
  Gene Symbol: CASP8
  Gene Name: caspase 8, apoptosis-related cysteine peptidase
  ENSP ID: ENSP00000390346
NLLDIFIEMEKRVILGEGKLDILKRVCAQINKSLLKIINDYEEFSKDFGQSLPNEKQTSGILSDHQQSQFCKSTGESAQTSQH

SEQ ID NO: 12301 - protein, 116 aa, Homo sapiens
  Payload ID: 2418
  Gene Symbol: CASP8
  Gene Name: caspase 8, apoptosis-related cysteine peptidase
  ENSP ID: ENSP00000390641
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSE

SEQ ID NO: 12302 - protein, 149 aa, Homo sapiens
  Payload ID: 2418
  Gene Symbol: CASP8
  Gene Name: caspase 8, apoptosis-related cysteine peptidase
  ENSP ID: ENSP00000391709
MLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDA

SEQ ID NO: 12303 - protein, 258 aa, Homo sapiens
  Payload ID: 2418
  Gene Symbol: CASP8
  Gene Name: caspase 8, apoptosis-related cysteine peptidase
  ENSP ID: ENSP00000394434
NLLDIFIEMEKRVILGEGKLDILKRVCAQINKSLLKIINDYEEFSKGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 12304 - protein, 124 aa, Homo sapiens
  Payload ID: 2418
  Gene Symbol: CASP8
  Gene Name: caspase 8, apoptosis-related cysteine peptidase
  ENSP ID: ENSP00000396869
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLL

SEQ ID NO: 12305 - protein, 198 aa, Homo sapiens
  Payload ID: 2418
  Gene Symbol: CASP8
  Gene Name: caspase 8, apoptosis-related cysteine peptidase
  ENSP ID: ENSP00000397528
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSN

SEQ ID NO: 12306 - protein, 58 aa, Homo sapiens
  Payload ID: 2418
  Gene Symbol: CASP8
  Gene Name: caspase 8, apoptosis-related cysteine peptidase
  ENSP ID: ENSP00000407378
MEGGRRARVVIESKRNFFLGAFPTPFPAEHVELGRLGDSETAMVPGKGGADGLQQKSL

SEQ ID NO: 12307 - protein, 479 aa, Homo sapiens
  Payload ID: 2418
  Gene Symbol: CASP8
  Gene Name: caspase 8, apoptosis-related cysteine peptidase
  Uniprot ID: Q14790
  ENSP ID: ENSP00000412523
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 12308 - protein, 266 aa, Homo sapiens
  Payload ID: 2419
  Gene Symbol: CASP9
  Gene Name: caspase 9, apoptosis-related cysteine peptidase
  Uniprot ID: P55211
  ENSP ID: ENSP00000255256
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 12309 - protein, 416 aa, Homo sapiens
  Payload ID: 2419
  Gene Symbol: CASP9
  Gene Name: caspase 9, apoptosis-related cysteine peptidase
  Uniprot ID: P55211
  ENSP ID: ENSP00000330237
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 12310 - protein, 333 aa, Homo sapiens
  Payload ID: 2419
  Gene Symbol: CASP9
  Gene Name: caspase 9, apoptosis-related cysteine peptidase
  Uniprot ID: P55211
  ENSP ID: ENSP00000365051
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 12311 - protein, 152 aa, Homo sapiens
  Payload ID: 2419
  Gene Symbol: CASP9
  Gene Name: caspase 9, apoptosis-related cysteine peptidase
  ENSP ID: ENSP00000383588
  MOD_RES (1)..(1): Any amino acid
XADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLTVL

SEQ ID NO: 12312 - protein, 266 aa, Homo sapiens
  Payload ID: 2419
  Gene Symbol: CASP9
  Gene Name: caspase 9, apoptosis-related cysteine peptidase
  ENSP ID: ENSP00000396540
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFP

SEQ ID NO: 12313 - protein, 198 aa, Homo sapiens
  Payload ID: 2419
  Gene Symbol: CASP9
  Gene Name: caspase 9, apoptosis-related cysteine peptidase
  ENSP ID: ENSP00000408691
  MOD_RES (1)..(1): Any amino acid
XCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGGFVSWRDPKSGSWYVETLDDIFEQWAHSEDLQSLLLRVANAVSVKGIYKQMPGCFNFLRKKLFFKTS

SEQ ID NO: 12314 - protein, 254 aa, Homo sapiens
  Payload ID: 2419
  Gene Symbol: CASP9
  Gene Name: caspase 9, apoptosis-related cysteine peptidase
  ENSP ID: ENSP00000411304
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKASHLQFPGAVYGTDGCPVSVEKIVNIFNGTSCPSLGGKPKLFFI

SEQ ID NO: 12315 - protein, 95 aa, Homo sapiens
  Payload ID: 2419
  Gene Symbol: CASP9
  Gene Name: caspase 9, apoptosis-related cysteine peptidase
  ENSP ID: ENSP00000449216
MDEADRRLLRRCRLRLVEELQVDQLWDALLSRELFRPHMIEDIQRAGSGSRRDQARQLIIDLETRGSQALPLFISCLEDTGQDMLASFLRTNRCS

SEQ ID NO: 12316 - protein, 421 aa, Homo sapiens
  Payload ID: 2419
  Gene Symbol: CASP9
  Gene Name: caspase 9, apoptosis-related cysteine peptidase
  ENSP ID: ENSP00000449584
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVSAAFLCKGEGRLLRGSVSSWGWGFGVSRAGPNQG

SEQ ID NO: 12317 - protein, 47 aa, Homo sapiens
  Payload ID: 2419
  Gene Symbol: CASP9
  Gene Name: caspase 9, apoptosis-related cysteine peptidase
  ENSP ID: ENSP00000480785
MLASFLRTNRQAAKLSKPTLENLTPVVLRPEIRKPEVLRPETPRPVD

SEQ ID NO: 12318 - protein, 361 aa, Homo sapiens
  Payload ID: 2420
  Gene Symbol: CAAP1
  Gene Name: caspase activity and apoptosis inhibitor 1
  Uniprot ID: Q9H8G2
  ENSP ID: ENSP00000369431
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQETKYILPTLEKELFLAEHSDLEEGGLDLTVSLKPVSFYISDKKEMLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 12319 - protein, 133 aa, Homo sapiens
  Payload ID: 2420
  Gene Symbol: CAAP1
  Gene Name: caspase activity and apoptosis inhibitor 1
  ENSP ID: ENSP00000427916
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQVRARPSGRFLELLLFRKKSGFQRDGAQAGAHC

SEQ ID NO: 12320 - protein, 111 aa, Homo sapiens
  Payload ID: 2420
  Gene Symbol: CAAP1
  Gene Name: caspase activity and apoptosis inhibitor 1
  ENSP ID: ENSP00000427938
MTGKKSSREKRRKRSSQEAAAALAAPDIVPALASGSSGSTSGCGSAGGCGSVSCCGNANFSGSVTGGGSGGSCWGGSSVERSERRKRRSTDSSSVSGSLQQEKGKIVMYSV

SEQ ID NO: 12321 - protein, 216 aa, Homo sapiens
  Payload ID: 2420
  Gene Symbol: CAAP1
  Gene Name: caspase activity and apoptosis inhibitor 1
  Uniprot ID: Q9H8G2
  ENSP ID: ENSP00000487373
MLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 12322 - protein, 1032 aa, Homo sapiens
  Payload ID: 2421
  Gene Symbol: CARD10
  Gene Name: caspase recruitment domain family, member 10
  Uniprot ID: Q9BWT7
  ENSP ID: ENSP00000251973
MPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQRLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 12323 - protein, 1032 aa, Homo sapiens; identical to SEQ ID NO: 12322
  Payload ID: 2421
  Gene Symbol: CARD10
  Gene Name: caspase recruitment domain family, member 10
  Uniprot ID: Q9BWT7
  ENSP ID: ENSP00000384570

SEQ ID NO: 12324 - protein, 746 aa, Homo sapiens
  Payload ID: 2421
  Gene Symbol: CARD10
  Gene Name: caspase recruitment domain family, member 10
  Uniprot ID: Q9BWT7
  ENSP ID: ENSP00000385799
MGVGVGLGNGLRLLPWMEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRELVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 12325 - protein, 192 aa, Homo sapiens
  Payload ID: 2421
  Gene Symbol: CARD10
  Gene Name: caspase recruitment domain family, member 10
  ENSP ID: ENSP00000393411
TSLYCPQMAGALETQVLSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERAD

SEQ ID NO: 12326 - protein, 480 aa, Homo sapiens
  Payload ID: 2421
  Gene Symbol: CARD10
  Gene Name: caspase recruitment domain family, member 10
  ENSP ID: ENSP00000416239
MEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRP

SEQ ID NO: 12327 - protein, 271 aa, Homo sapiens
  Payload ID: 2422
  Gene Symbol: CARD11
  Gene Name: caspase recruitment domain family, member 11
  ENSP ID: ENSP00000347695
EEGTDASPSSCGSLPITNSFTKMPPRSRSSIMSITAEPPGNDSIVRRYKEDAPHRSTVEEDNDSGGFDALDLDDDSHERYSFGPSSIHSSSSSHQSEGLDAYDLEQVNLMFRKFSLERPFRPSVTSVGHVRGPGPSVQHTTLNGDSLTSQLTLLGGNARGSFVHSVKPGSLAEKAGLREGHQLLLLEGCIRGERQSVPLDTCTKEEAHWTIQRCSGPVTLHYKVNHEGYRKLVKDMEDGLITSGDSFYIRLNLNISSQLDACTMSLKCDDV

SEQ ID NO: 12328 - protein, 73 aa, Homo sapiens
  Payload ID: 2422
  Gene Symbol: CARD11
  Gene Name: caspase recruitment domain family, member 11
  ENSP ID: ENSP00000348779
MPGGGPEMDDYMETLKDEEDALWENVECNRHMLSRYINPAKLTPYLRQCKVIDEQDEDEVLNAPMLPSKINRA

SEQ ID NO: 12329 - protein, 1154 aa, Homo sapiens [sequence omitted]

SEQ ID NO: 12330 - protein, 1004 aa, Homo sapiens
  Payload ID: 2423
  Gene Symbol: CARD14
  Gene Name: caspase recruitment domain family, member 14
  Uniprot ID: Q9BXL6
  ENSP ID: ENSP00000344549
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVDYEASEPLFKAVLEDTTLEEAVGLLRRVDGFCCLSVKVNTDGYKRLLQDLEAKVATSGDSFYIRVNLAMEGRAKGELQVHCNEVLHVTDTMFQGCGCWHAHRVNSYTMKDTAAHGTIPNYSRAQQQLIALIQDMTQQCTVTRKPSSGGPQKLVRIVSMDKAKASPLRLSFDRGQLDPSRMEGSSTCFWAESCLTLVPYTLVRPHRPARPRPVLLVPRAVGKILSEKLCLLQGFKKCLAEYLSQEEYEAWSQRGDIIQEGEVSGGRCWVTRHAVESLMEKNTHALLDVQLDSVCTLHRMDIFPIVIHVSVNEKMAKKLKKGLQRLGTSEEQLLEAARQEEGDLDRAPCLYSSLAPDGWSDLDGLLSCVRQAIADEQKKVVWTEQSPR

SEQ ID NO: 12331 - protein, 1004 aa, Homo sapiens; identical to SEQ ID NO: 12330
  Payload ID: 2423
  Gene Symbol: CARD14
  Gene Name: caspase recruitment domain family, member 14
  Uniprot ID: Q9BXL6
  ENSP ID: ENSP00000458715

SEQ ID NO: 12332 - protein, 70 aa, Homo sapiens
  Payload ID: 2423
  Gene Symbol: CARD14
  Gene Name: caspase recruitment domain family, member 14
  ENSP ID: ENSP00000459244
MGELCRRDSALTALDEETLWEMMESHRHRIVRCICPSRLTPYLRQAKVLCQLDEEEVLHSPRLTNSAMRA

SEQ ID NO: 12333 - protein, 475 aa, Homo sapiens
  Payload ID: 2423
  Gene Symbol: CARD14
  Gene Name: caspase recruitment domain family, member 14
  ENSP ID: ENSP00000460405
  MOD_RES (1)..(1): Any amino acid
XYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVIRGYSRTWRPKWRPRGTHSTSGSTWPWRAGPKGSCRCIATRSCTSPTPCSRAAAAGMPTA

SEQ ID NO: 12334 - protein, 493 aa, Homo sapiens
  Payload ID: 2423
  Gene Symbol: CARD14
  Gene Name: caspase recruitment domain family, member 14
  ENSP ID: ENSP00000460883
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQGEGECAAGPGVRAAEGARPGVLREGQCSEGDFPEPGGEGLPPQAGVRADGPGLRAAHTASPAAGRASGCAQAGSQDQGALSTGEAAAGADACHLPQRRQRLQPRQLHRVSALVGPECHVQPRAGGQLPLQQPRAPQPAVPVQAGGRGLRGRTLVFQQLPGDPGGRPGSPAGS

SEQ ID NO: 12335 - protein, 43 aa, Homo sapiens
  Payload ID: 2423
  Gene Symbol: CARD14
  Gene Name: caspase recruitment domain family, member 14
  ENSP ID: ENSP00000461447
MGELCRRDSALTALDEETLWEMMESHRHRIVRCICPSRLTPYL

SEQ ID NO: 12336 - protein, 740 aa, Homo sapiens
  Payload ID: 2423
  Gene Symbol: CARD14
  Gene Name: caspase recruitment domain family, member 14
  Uniprot ID: Q9BXL6
  ENSP ID: ENSP00000461806
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVDYEASEPLFKAVLEDTTLEEAVGLLRRVDGFCCLSVKVNTDGYKRLLQDLEAKVATSGDSFYIRVNLAMEGRAKGELQVHCNEVLHVTDTMFQGCGCWHAHRVNSYTMKDTAAHGTIPNYSR

SEQ ID NO: 12337 - protein, 97 aa, Homo sapiens
  Payload ID: 2424
  Gene Symbol: CARD16
  Gene Name: caspase recruitment domain family, member 16
  Uniprot ID: Q5EG05
  ENSP ID: ENSP00000364856
MADKVLKEKRKLFIHSMGEGTINGLLDELLQTRVLNQEEMEKVKRENATVMDKTRALIDSVIPKGAQACQICITYICEEDSYLAETLGLSAGPIPGN

SEQ ID NO: 12338 - protein, 197 aa, Homo sapiens
  Payload ID: 2424
  Gene Symbol: CARD16
  Gene Name: caspase recruitment domain family, member 16
  Uniprot ID: Q5EG05
  ENSP ID: ENSP00000364858
MADKVLKEKRKLFIHSMGEGTINGLLDELLQTRVLNQEEMEKVKRENATVMDKTRALIDSVIPKGAQACQICITYICEEDSYLAETLGLSAALQAVQDNPAMPTCSSPEGRIKLCFLEDAQRIWKQKLQRCHVQNTIIKWSERYTSGSFEMQWLFLRTNFIERFWRNILLLPLHKGSLYPRIPGLGKELQTGTHKLS

SEQ ID NO: 12339 - protein, 95 aa, Homo sapiens
  Payload ID: 2424
  Gene Symbol: CARD16
  Gene Name: caspase recruitment domain family, member 16
  ENSP ID: ENSP00000432485
MGEGTINGLLDELLQTRVLNQEEMEKVKRENATVMDKTRALIDSVIPKGAQACQICITYICEEDSYLAETLGLSAALQAVQDNPAMPTCSSPEGR

SEQ ID NO: 12340 - protein, 97 aa, Homo sapiens; identical to SEQ ID NO: 12337
  Payload ID: 2424
  Gene Symbol: CARD16
  Gene Name: caspase recruitment domain family, member 16
  Uniprot ID: Q5EG05
  ENSP ID: ENSP00000433700

SEQ ID NO: 12341 - protein, 110 aa, Homo sapiens
  Payload ID: 2425
  Gene Symbol: CARD17
  Gene Name: caspase recruitment domain family, member 17
  Uniprot ID: Q5XLA6
  ENSP ID: ENSP00000364859
MADKVLKEKRKQFIRSVGEGTINGLLGELLETRVLSQEEIEIVKCENATVMDKARALLDSVIRKGAPACQICITYICEEDSHLAGTLGLSAGPTSGNHLTTQDSQIVLPS

SEQ ID NO: 12342 - protein, 90 aa, Homo sapiens
  Payload ID: 2426
  Gene Symbol: CARD18
  Gene Name: caspase recruitment domain family, member 18
  Uniprot ID: P57730
  ENSP ID: ENSP00000436691
MADQLLRKKRRIFIHSVGAGTINALLDCLLEDEVISQEDMNKVRDENDTVMDKARVLIDLVTGKGPKSCCKFIKHLCEEDPQLASKMGLH

SEQ ID NO: 12343 - protein, 51 aa, Homo sapiens
  Payload ID: 2426
  Gene Symbol: CARD18
  Gene Name: caspase recruitment domain family, member 18
  ENSP ID: ENSP00000437035
MNKVRDENDTVMDKARVLIDLVTGKGPKSCCKFIKHLCEEDPQLASKMGLH

SEQ ID NO: 12344 - protein, 51 aa, Homo sapiens; identical to SEQ ID NO: 12343
  Payload ID: 2426
  Gene Symbol: CARD18
  Gene Name: caspase recruitment domain family, member 18
  ENSP ID: ENSP00000437187

SEQ ID NO: 12345 - protein, 183 aa, Homo sapiens
  Payload ID: 2427
  Gene Symbol: CARD19
  Gene Name: caspase recruitment domain family, member 19
  Uniprot ID: Q96LW7
  ENSP ID: ENSP00000364613
MTDQTYCDRLVQDTPFLTGHGRLSEQQVDRIILQLNRYYPQILTNKEAEKFRNPKASLRVRLCDLLSHLQRSGERDCQEFYRALYIHAQPLHSRLPSRHALQNSDCTELDSGSQSGELSNRGPMSFLAGLGLAVGLALLLYCYPPDPKGLPGTRRVLGFSPVIIDRHVSRYLLAFLADDLGGL

SEQ ID NO: 12346 - protein, 228 aa, Homo sapiens
  Payload ID: 2427
  Gene Symbol: CARD19
  Gene Name: caspase recruitment domain family, member 19
  Uniprot ID: Q96LW7
  ENSP ID: ENSP00000437237
MTDQTYCDRLVQDTPFLTGHGRLSEQQVDRIILQLNRYYPQILTNKEAEKFRNPKASLRVRLCDLLSHLQRSGERDCQEFYRALYIHAQPLHSRLPSRHALRKFHITNHACLVLARGGHPSLPLMAWMSSMTTQVCCSPGLASPLASAPPQRPPSGPEGRVWQAQAVQMLVSVSHFLPLPPSLSHGSFHTAWGILYVHSCPSFSNLIPRGSLHVCVDSNLVPTAAWRS

SEQ ID NO: 12347 - protein, 1037 aa, Homo sapiens
  Payload ID: 2428
  Gene Symbol: CARD6
  Gene Name: caspase recruitment domain family, member 6
  Uniprot ID: Q9BX69
  ENSP ID: ENSP00000254691
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEERKKVFKDVLLCLNMDRSRKVLPDFVKQFSLDRGCKWTPESPGDLAWNFLMKVQARDVTARDSILSHKVLDEDSKEDLLAGVENLEIRDIQTINPLDVLCATMLCSDSSLQRQVMSNMYQCQFALPLLLPDAENNKSILMLGAMKDIVKKQSTQFSGGPTEDTEKFLTLMKMPVISFVRLGYCSFSKSRILNTLLSPAQLKLHKIFLHQDLPLLVLPRQISDGLVEITWCFPDSDDRKENPFFQKPVALANLRGNLESFWTQFGFLMEVSSAVFFFTDCLGEKEWDLLMFLGEAAIERCYFVLSSQARESEEAQIFQRILNLKPAQLLFWERGDAGDRRKNMEGLQAALQEVMFSSCLRCVSVEDMAALARELGIQVDEDFENTQRIQVSSGENMAGTAEGEGQQRHSQLKSSSKSQALMPIQEPGTQCELSQNLQNLYGTPVFRPVLENSWLFPTRIGGNFNHVSLKASWVMGRPFGSEQRPKWFHPLPFQNAGAQGRGKSFGIQSFHPQIFYSGERFMKFSRVARGCHSNGTFGRLPRPICQHVQACPERPQMMGTLERSRAVASKIGHSYSLDSQPARAVGKPWPQQACTRVTELTEATGKLIRTSHIGKPHPQSFQPAAATQKLRPASQQGVQMKTQGGASNPALQIGSHPMCKSSQFKSDQSNPSTVKHSQPKPFHSVPSQPKSSQTKSCQSQPSQTKPSPCKSTQPKPSQPWPPQSKPSQPRPPQPKSSSTNPSQAKAHHSKAGQKRGGKH

SEQ ID NO: 12348 - protein, 310 aa, Homo sapiens
  Payload ID: 2428
  Gene Symbol: CARD6
  Gene Name: caspase recruitment domain family, member 6
  ENSP ID: ENSP00000371093
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEFSGEEPSYEGSETSLSLEEEQEKSIEGWSRTHGLKRSSHVGLPKCWDYRREPPCLA

SEQ ID NO: 12349 - protein, 283 aa, Homo sapiens
  Payload ID: 2429
  Gene Symbol: CARD8
  Gene Name: caspase recruitment domain family, member 8
  ENSP ID: ENSP00000350423
MTRNILVPFFVWIQRSETAYSGHSQLSFDICIPTAPVQFSLQESFRPCLFQPFTSYMSSIFFSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQAGEVDVSWFLVAHFKNEGMVLEHPARVEPFYAVLESPSFSLMGILLRIASGTRLSIPITSNTLIYYHPHPEDIKFHLYLVPSDALLTKVRQSL

SEQ ID NO: 12350 - protein, 537 aa, Homo sapiens
  Payload ID: 2429
  Gene Symbol: CARD8
  Gene Name: caspase recruitment domain family, member 8
  Uniprot ID: Q9Y2G2
  ENSP ID: ENSP00000375767
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQAGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 12351 - protein, 487 aa, Homo sapiens
  Payload ID: 2429
  Gene Symbol: CARD8
  Gene Name: caspase recruitment domain family, member 8
  Uniprot ID: Q9Y2G2
  ENSP ID: ENSP00000391248
MEKKECPEKSSSSEEELPRRVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQAGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 12352 - protein, 70 aa, Homo sapiens
  Payload ID: 2429
  Gene Symbol: CARD8
  Gene Name: caspase recruitment domain family, member 8
  ENSP ID: ENSP00000427727
MEKKECPEKSSSSEEELPRRDSGSSRNIDASKLIRLQGSRKLLVDNSIRELQYTKTGIFFQAEACVTNDT

SEQ ID NO: 12353 - protein, 487 aa, Homo sapiens; identical to SEQ ID NO: 12351
  Payload ID: 2429
  Gene Symbol: CARD8
  Gene Name: caspase recruitment domain family, member 8
  Uniprot ID: Q9Y2G2
  ENSP ID: ENSP00000427858

SEQ ID NO: 12354 - protein, 70 aa, Homo sapiens; identical to SEQ ID NO: 12352
  Payload ID: 2429
  Gene Symbol: CARD8
  Gene Name: caspase recruitment domain family, member 8
  ENSP ID: ENSP00000427922

SEQ ID NO: 12355 - protein, 82 aa, Homo sapiens
  Payload ID: 2429
  Gene Symbol: CARD8
  Gene Name: caspase recruitment domain family, member 8
  ENSP ID: ENSP00000428662
MEKKECPEKSSSSEEELPRRVYRELPCVSETLCDISHFFQEDDETEAEPLLFRAVPECQLSGGDIPRRHLLRRESNSFLLCF

SEQ ID NO: 12356 - protein, 487 aa, Homo sapiens; identical to SEQ ID NO: 12351
  Payload ID: 2429
  Gene Symbol: CARD8
  Gene Name: caspase recruitment domain family, member 8
  Uniprot ID: Q9Y2G2
  ENSP ID: ENSP00000428736

SEQ ID NO: 12357 - protein, 132 aa, Homo sapiens
  Payload ID: 2429
  Gene Symbol: CARD8
  Gene Name: caspase recruitment domain family, member 8
  ENSP ID: ENSP00000428862
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPRRHLLRRESNSFLLCF

SEQ ID NO: 12358 - protein, 537 aa, Homo sapiens; identical to SEQ ID NO: 12350
  Payload ID: 2429
  Gene Symbol: CARD8
  Gene Name: caspase recruitment domain family, member 8
  Uniprot ID: Q9Y2G2
  ENSP ID: ENSP00000428883

SEQ ID NO: 12359 - protein, 70 aa, Homo sapiens
  Payload ID: 2429
  Gene Symbol: CARD8
  Gene Name: caspase recruitment domain family, member 8
  ENSP ID: ENSP00000428975
  MOD_RES (1)..(1): Any amino acid
XGQMKEPIQLEITEKRHGTLVWDTEVKPVDLQLVAASAPPPFSGVRMWPGCCPILPRTGCTCLCLNPWLP

SEQ ID NO: 12360 - protein, 138 aa, Homo sapiens
  Payload ID: 2429
  Gene Symbol: CARD8
  Gene Name: caspase recruitment domain family, member 8
  ENSP ID: ENSP00000429362
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPRYLFFLNLIHVSVSLLVSFTSK

SEQ ID NO: 12361 - protein, 132 aa, Homo sapiens
  Payload ID: 2429
  Gene Symbol: CARD8
  Gene Name: caspase recruitment domain family, member 8
  ENSP ID: ENSP00000429741
MEKKECPEKSSSSEEELPRRVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYRR

SEQ ID NO: 12362 - protein, 392 aa, Homo sapiens
  Payload ID: 2429
  Gene Symbol: CARD8
  Gene Name: caspase recruitment domain family, member 8
  Uniprot ID: Q9Y2G2
  ENSP ID: ENSP00000429839
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQAGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKWISSL

SEQ ID NO: 12363 - protein, 82 aa, Homo sapiens; identical to SEQ ID NO: 12355
  Payload ID: 2429
  Gene Symbol: CARD8
  Gene Name: caspase recruitment domain family, member 8
  ENSP ID: ENSP00000430057

SEQ ID NO: 12364 - protein, 70 aa, Homo sapiens; identical to SEQ ID NO: 12352
  Payload ID: 2429
  Gene Symbol: CARD8
  Gene Name: caspase recruitment domain family, member 8
  ENSP ID: ENSP00000430108

SEQ ID NO: 12365 - protein, 39 aa, Homo sapiens
  Payload ID: 2429
  Gene Symbol: CARD8
  Gene Name: caspase recruitment domain family, member 8
  ENSP ID: ENSP00000430178
MEKKECPEKSSSSEEELPRRDSGSSRNIDASKLIRLQGS

SEQ ID NO: 12366 - protein, 24 aa, Homo sapiens
  Payload ID: 2429
  Gene Symbol: CARD8
  Gene Name: caspase recruitment domain family, member 8
  ENSP ID: ENSP00000430460
  MOD_RES (1)..(1): Any amino acid
XHPEDIKFHLYLVPSDALLTKTLF

SEQ ID NO: 12367 - protein, 82 aa, Homo sapiens; identical to SEQ ID NO: 12355
  Payload ID: 2429
  Gene Symbol: CARD8
  Gene Name: caspase recruitment domain family, member 8
  ENSP ID: ENSP00000430495

SEQ ID NO: 12368 - protein, 43 aa, Homo sapiens
  Payload ID: 2429
  Gene Symbol: CARD8
  Gene Name: caspase recruitment domain family, member 8
  ENSP ID: ENSP00000430567
MEKKECPEKSSSSEEELPRRVYRELPCVSETLCDISHFFQEDD

SEQ ID NO: 12369 - protein, 392 aa, Homo sapiens; identical to SEQ ID NO: 12362
  Payload ID: 2429
  Gene Symbol: CARD8
  Gene Name: caspase recruitment domain family, member 8
  Uniprot ID: Q9Y2G2
  ENSP ID: ENSP00000430747

SEQ ID NO: 12370 - protein, 146 aa, Homo sapiens
  Payload ID: 2429
  Gene Symbol: CARD8
  Gene Name: caspase recruitment domain family, member 8
  ENSP ID: ENSP00000430836
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPSLDPPSLRELSVMTGVFHSLLHSVIAVSDM

SEQ ID NO: 12371 - protein, 536 aa, Homo sapiens
  Payload ID: 2430
  Gene Symbol: CARD9
  Gene Name: caspase recruitment domain family, member 9
  Uniprot ID: Q9H257
  ENSP ID: ENSP00000360797
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGLSSGEPPEKERRRLKESFENYRRKRALRKMQKGWRQGEEDRENTTGSDNTDTEGS

SEQ ID NO: 12372 - protein, 492 aa, Homo sapiens
  Payload ID: 2430
  Gene Symbol: CARD9
  Gene Name: caspase recruitment domain family, member 9
  Uniprot ID: Q9H257
  ENSP ID: ENSP00000360799
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQAIATREELHAQHARGLQEKDALRKQVRELGEKADELQLQVFQCEAQLLAVEGRLRRQQLETLVLSSDLEDGSPRRSQELSLPQDLEDTQLSDKGCLAGGGSPKQPFAALHQEQVLRNPHDAGPAGLPGIGAVC

SEQ ID NO: 12373 - protein, 366 aa, Homo sapiens
  Payload ID: 2430
  Gene Symbol: CARD9
  Gene Name: caspase recruitment domain family, member 9
  Uniprot ID: Q9H257
  ENSP ID: ENSP00000451368
MSDYENDDECWSVLEGFRVTLTSVIDPSRITPYLRQCKVLNPDDEEQVLSDPNLVIRKRKVGVLLDILQRTGHKGYVAFLESLELYYPQLYKKVTGKEPARVFSMIIDASGESGLTQLLMTEVMKLQKKVQDLTALLSSKDDFIKELRVKDSLLRKHQERVQRLKEECEAGSRELKRCKEENYDLAMRLAHQSEEKGAALMRNRDLQLEIDQLKHSLMKAEDDCKVERKHTLKLRHAMEQRPSQELLWELQQEKALLQARVQELEASVQEGKLDRSSPYIQVLEEDWRQALRDHQEQANTIFSLRKDLRQGEARRLRCMEEKEMFELQCLALRKDSKMYKDRIEAILLQMEEVAIERDQSTQMEGL

SEQ ID NO: 12374 - protein, 1166 aa, Homo sapiens
  Payload ID: 2431
  Gene Symbol: CASZ1
  Gene Name: castor zinc finger 1
  Uniprot ID: Q86V15
  ENSP ID: ENSP00000339445
MDLGTAEGTRCTDPPAGKPAMAPKRKGGLKLNAICAKLSRQVVVEKRADAGSHTEGSPSQPRDQERSGPESGAARAPRSEEDKRRAVIEKWVNGEYSEEPAPTPVLGRIAREGLELPPEGVYMVQPQGCSDEEDHAEEPSKDGGALEEKDSDGAASKEDSGPSTRQASGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQEK

SEQ ID NO: 12375 - protein, 1759 aa, Homo sapiens
  Payload ID: 2431
  Gene Symbol: CASZ1
  Gene Name: castor zinc finger 1
  Uniprot ID: Q86V15
  ENSP ID: ENSP00000366221
MDLGTAEGTRCTDPPAGKPAMAPKRKGGLKLNAICAKLSRQVVVEKRADAGSHTEGSPSQPRDQERSGPESGAARAPRSEEDKRRAVIEKWVNGEYSEEPAPTPVLGRIAREGLELPPEGVYMVQPQGCSDEEDHAEEPSKDGGALEEKDSDGAASKEDSGPSTRQASGEASSLRDYAASTMTEFLGMFGYDDQNTRDELARKISFEKLHAGSTPEAATSSMLPTSEDTLSKRARFSKYEEYIRKLKAGEQLSWPAPSTKTEERVGKEVVGTLPGLRLPSSTAHLETKATILPLPSHSSVQMQNLVARASKYDFFIQKLKTGENLRPQNGSTYKKPSKYDLENVKYLHLFKPGEGSPDMGGAIAFKTGKVGRPSKYDVRGIQKPGPAKVPPTPSLAPAPLASVPSAPSAPGPGPEPPASLSFNTPEYLKSTFSKTDSITTGTVSTVKNGLPTDKPAVTEDVNIYQKYIARFSGSQHCGHIHCAYQYREHYHCLDPECNYQRFTSKQDVIRHYNMHKKRDNSLQHGFMRFSPLDDCSVYYHGCHLNGKSTHYHCMQVGCNKVYTSTSDVMTHENFHKKNTQLINDGFQRFRATEDCGTADCQFYGQKTTHFHCRRPGCTFTFKNKCDIEKHKSYHIKDDAYAKDGFKKFYKYEECKYEGCVYSKATNHFHCIRAGCGFTFTSTSQMTSHKRKHERRHIRSSGALGLPPSLLGAKDTEHEESSNDDLVDFSALSSKNSSLSASPTSQQSSASLAAATAATEAGPSATKPPNSKISGLLPQGLPGSIPLALALSNSGLPTPTPYFPILAGRGSTSLPVGTPSLLGAVSSGSAASATPDTPTLVASGAGDSAPVAAASVPAPPASIMERISASKGLISPMMARLAAAALKPSATFDPGSGQQVTPARFPPAQVKPEPGESTGAPGPHEASQDRSLDLTVKEPSNESNGHAVPANSSLLSSLMNKMSQGNPGLGSLLNIKAEAEGSPAAEPSPFLGKAVKALVQEKLAEPWKVYLRRFGTKDFCDGQCDFLHKAHFHCVVEECGALFSTLDGAIKHANFHFRTEGGAAKGNTEAAFPASAAETKPPMAPSSPPVPPVTTATVSSLEGPAPSPASVPSTPTLLAWKQLASTIPQMPQIPASVPHLPASPLATTSLENAKPQVKPGFLQFQENDPCLATDCKYANKFHFHCLFGNCKYVCKTSGKAESHCLDHINPNNNLVNVRDQFAYYSLQCLCPNQHCEFRMRGHYHCLRTGCYFVTNITTKLPWHIKKHEKAERRAANGFKYFTKREECGRLGCKYNQVNSHFHCIREGCQFSFLLKHQMTSHARKHMRRMLGKNFDRVPPSQGPPGLMDAETDECMDYTGCSPGAMSSESSTMDRSCSSTPVGNESTAAGNTISMPTASGAKKRFWIIEDMSPFGKRRKTASSRKMLDEGMMLEGFRRFDLYEDCKDAACQFSLKVTHYHCTRENCGYKFCGRTHMYKHAQHHDRVDNLVLDDFKRFKASLSCHFADCPFSGTSTHFHCLRCRFRCTDSTKVTAHRKHHGKQDVISAAGFCQFSSSADCAVPDCKYKLKCSHFHCTFPGCRHTVVGMSQMDSHKRKHEKQERGEPAAEGPAPGPPISLDGSLSLGAEPGSLLFLQSAAAGLGLALGDAGDPGPPDAAAPGPREGAAAAAAAAGESSQEDEEEELELPEEEAEDDEDEDDDEDDDDEDDDEDDDDEDLRTDSEESLPEAAAEAAGAGARTPALAALAALGAPGPAPTAASSP

SEQ ID NO: 12376 - protein, 231 aa, Homo sapiens
  Payload ID: 2431
  Gene Symbol: CASZ1
  Gene Name: castor zinc finger 1
  ENSP ID: ENSP00000467769
RMRGHYHCLRTGCYFVTNITTKLPWHIKKHEKAERRAANGFKYFTKREECGRLGCKYNQVNSHFHCIREGCQFSFLLKHQMTSHARKHMRRMLGKNFDRVPPSQGPPGLMDAETDECMDYTGCSPGAMSSESSTMDRSCSSTPVGNESTAAGCPAPPPPPLPPPAAAGDEAARTAPQPPATPSFSPATLRPPLPPLPCLFSPSCLSYSLLSATLGAGRGLAHPTCSPPSFP

SEQ ID NO: 12377 - protein, 511 aa, Homo sapiens
  Payload ID: 2432
  Gene Symbol: CECR1
  Gene Name: cat eye syndrome chromosome region, candidate 1
  Uniprot ID: Q9NZK5
  ENSP ID: ENSP00000262607
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 12378 - protein, 270 aa, Homo sapiens
  Payload ID: 2432
  Gene Symbol: CECR1
  Gene Name: cat eye syndrome chromosome region, candidate 1
  Uniprot ID: Q9NZK5
  ENSP ID: ENSP00000332871
MDSLEWNWALVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 12379 - protein, 511 aa, Homo sapiens; identical to SEQ ID NO: 12377
  Payload ID: 2432
  Gene Symbol: CECR1
  Gene Name: cat eye syndrome chromosome region, candidate 1
  Uniprot ID: Q9NZK5
  ENSP ID: ENSP00000382731

SEQ ID NO: 12380 - protein, 511 aa, Homo sapiens; identical to SEQ ID NO: 12377
  Payload ID: 2432
  Gene Symbol: CECR1
  Gene Name: cat eye syndrome chromosome region, candidate 1
  Uniprot ID: Q9NZK5
  ENSP ID: ENSP00000382733

SEQ ID NO: 12381 - protein, 135 aa, Homo sapiens
  Payload ID: 2432
  Gene Symbol: CECR1
  Gene Name: cat eye syndrome chromosome region, candidate 1
  ENSP ID: ENSP00000392078
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCH

SEQ ID NO: 12382 - protein, 469 aa, Homo sapiens
  Payload ID: 2432
  Gene Symbol: CECR1
  Gene Name: cat eye syndrome chromosome region, candidate 1
  ENSP ID: ENSP00000406443
MMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 12383 - protein, 152 aa, Homo sapiens
  Payload ID: 2432
  Gene Symbol: CECR1
  Gene Name: cat eye syndrome chromosome region, candidate 1
  ENSP ID: ENSP00000442482
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPT

SEQ ID NO: 12384 - protein, 391 aa, Homo sapiens
  Payload ID: 2432
  Gene Symbol: CECR1
  Gene Name: cat eye syndrome chromosome region, candidate 1
  ENSP ID: ENSP00000483418
MDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 12385 - protein, 1301 aa, Homo sapiens
  Payload ID: 2433
  Gene Symbol: CECR2
  Gene Name: cat eye syndrome chromosome region, candidate 2
  ENSP ID: ENSP00000262608
MYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGKRPQRTKAELHPRWMSDHLSIKPVKQEETPVLTRIEKQKRKEEEEERQILLAVQKKEQEQMLKEERKRELEEKVKAVEDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVPEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQAEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 12386 - protein, 1484 aa, Homo sapiens
  Payload ID: 2433
  Gene Symbol: CECR2
  Gene Name: cat eye syndrome chromosome region, candidate 2
  Uniprot ID: Q9BXF3
  ENSP ID: ENSP00000341219
MCPEEGGAAGLGELRSWWEVPAIAHFCSLFRTAFRLPDFEIEELEAALHRDDVEFISDLIACLLQGCYQRRDITPQTFHSYLEDIINYRWELEEGKPNPLREASFQDLPLRTRVEILHRLCDYRLDADDVFDLLKGLDADSLRVEPLGEDNSGALYWYFYGTRMYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGKRPQRTKAELHPRWMSDHLSIKPVKQEETPVLTRIEKQKRKEEEEERQILLAVQKKEQEQMLKEERKRELEEKVKAVEGMCSVRVVWRGACLSTSRPVDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVPEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQAEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 12387 - protein, 218 aa, Homo sapiens
  Payload ID: 2433
  Gene Symbol: CECR2
  Gene Name: cat eye syndrome chromosome region, candidate 2
  ENSP ID: ENSP00000347357
SDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGFKRFSCLILPSSWDYRCPPPHLAEFCMIL

SEQ ID NO: 12388 - protein, 1300 aa, Homo sapiens
  Payload ID: 2433
  Gene Symbol: CECR2
  Gene Name: cat eye syndrome chromosome region, candidate 2
  ENSP ID: ENSP00000383428
MYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGKRPQRTKAELHPRWMSDHLSIKPVKQEETPVLTRIEKQKRKEEEEERQILLAVQKKEQEQMLKEERKRELEEKVKAVEDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVPEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 12389 - protein, 1442 aa, Homo sapiens
  Payload ID: 2433
  Gene Symbol: CECR2
  Gene Name: cat eye syndrome chromosome region, candidate 2
  ENSP ID: ENSP00000477529
MPFKIQWFFKAVADGLSLEKELEAALHRDDVEFISDLIACLLQGCYQRRDITPQTFHSYLEDIINYRWELEEGKPNPLREASFQDLPLRTRVEILHRLCDYRLDADDVFDLLKGLDADSLRVEPLGEDNSGALYWYFYGTRMYKEDPVQGKSNGELSLSRESEGQKNVSSIPGKTGKRRGRPPKRKKLQEEILLSEKQEENSLASEPQTRHGSQGPGQGTWWLLCQTEEEWRQVTESFRERTSLRERQLYKLLSEDFLPEICNMIAQKGKRPQRTKAELHPRWMSDHLSIKPVKQEETPVLTRIEKQKRKEEEEERQILLAVQKKEQEQMLKEERKRELEEKVKAVEDRAKRRKLREERAWLLAQGKELPPELSHLDPNSPMREEKKTKDLFELDDDFTAMYKVLDVVKAHKDSWPFLEPVDESYAPNYYQIIKAPMDISSMEKKLNGGLYCTKEEFVNDMKTMFRNCRKYNGESSEYTKMSDNLERCFHRAMMKHFPGEDGDTDEEFWIREDEKREKRRSRAGRSGGSHVWTRSRDPEGSSRKQQPMENGGKSLPPTRRAPSSGDDQSSSSTQPPREVGTSNGRGFSHPLHCGGTPSQAPFLNQMRPAVPGTFGPLRGSDPATLYGSSGVPEPHPGEPVQQRQPFTMQPPVGINSLRGPRLGTPEEKQMCGGLTHLSNMGPHPGSLQLGQISGPSQDGSMYAPAQFQPGFIPPRHGGAPARPPDFPESSEIPPSHMYRSYKYLNRVHSAVWNGNHGATNQGPLGPDEKPHLGPGPSHQPRTLGHVMDSRVMRPPVPPNQWTEQSGFLPHGVPSSGYMRPPCKSAGHRLQPPPVPAPSSLFGAPAQALRGVQGGDSMMDSPEMIAMQQLSSRVCPPGVPYHPHQPAHPRLPGPFPQVAHPMSVTVSAPKPALGNPGRAPENSEAQEPENDQAEPLPGLEEKPPGVGTSEGVYLTQLPHPTPPLQTDCTRQSSPQERETVGPELKSSSSESADNCKAMKGKNPWPSDSSYPGPAAQGCVRDLSTVADRGALSENGVIGEASPCGSEGKGLGSSGSEKLLCPRGRTLQETMPCTGQNAATPPSTDPGLTGGTVSQFPPLYMPGLEYPNSAAHYHISPGLQGVGPVMGGKSPASHPQHFPPRGFQSNHPHSGGFPRYRPPQGMRYSYHPPPQPSYHHYQRTPYYACPQSFSDWQRPLHPQGSPSGPPASQPPPPRSLFSDKNAMASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGMQMHPVQSQASFPKTPTAATSQEEVPPHKPPTLPLDQS

SEQ ID NO: 12390 - protein, 393 aa, Homo sapiens
  Payload ID: 2434
  Gene Symbol: CECR5
  Gene Name: cat eye syndrome chromosome region, candidate 5
  Uniprot ID: Q9BXW7
  ENSP ID: ENSP00000155674
MYAWFFLPSFSQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 12391 - protein, 423 aa, Homo sapiens
  Payload ID: 2434
  Gene Symbol: CECR5
  Gene Name: cat eye syndrome chromosome region, candidate 5
  Uniprot ID: Q9BXW7
  ENSP ID: ENSP00000337358
MAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 12392 - protein, 223 aa, Homo sapiens
  Payload ID: 2434
  Gene Symbol: CECR5
  Gene Name: cat eye syndrome chromosome region, candidate 5
  ENSP ID: ENSP00000382745
MAAWGCVAALGAARGLCWRAARAAAGLQGRPARRCYAVGPAQPLPRNDFPRIEGVLLLGEPVRWETSLQLIMDVLLSNGSPGAGLATPPYPHLPVLASNMDLLWMAEAKMPSDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 12393 - protein, 578 aa, Homo sapiens
  Payload ID: 2435
  Gene Symbol: CECR6
  Gene Name: cat eye syndrome chromosome region, candidate 6
  Uniprot ID: Q9BXQ6
  ENSP ID: ENSP00000329318
MRPALGHPRSVSSASGSFPPPPAAARLQPLFLRGGSFRGRRGSGDSSTSTSTSRGGGGGRRGGGGGSPSSSTGAEREDDDESLSVSKPLVPNAALLGPPAQVGAPAGPAPVAFSSSAATSSSTSTPTSSCSMTAADFGGGAAAGAVGGPGSRSAGGAGGTGTGSGASCCPCCCCCGCPDRPGRRGRRRGCAPSPRCRWGYQALSVVLLLAQGGLLDLYLIAVTDLYWCSWIATDLVVVVGWAIFFAKNSRGRRGGAASGAHNHHLHHHHAAPPLHLPAPSAATAGAKARGARGGAGGAGGGLGAAAAAGEFAFAYLAWLIYSIAFTPKVVLILGTSILDLIELRAPFGTTGFRLTMALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 12394 - protein, 223 aa, Homo sapiens
  Payload ID: 2435
  Gene Symbol: CECR6
  Gene Name: cat eye syndrome chromosome region, candidate 6
  Uniprot ID: Q9BXQ6
  ENSP ID: ENSP00000382764
MALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 12395 - protein, 527 aa, Homo sapiens
  Payload ID: 2436
  Gene Symbol: CAT
  Gene Name: catalase
  Uniprot ID: P04040
  ENSP ID: ENSP00000241052
MADSRDPASDQMQHWKEQRAAQKADVLTTGAGNPVGDKLNVITVGPRGPLLVQDVVFTDEMAHFDRERIPERVVHAKGAGAFGYFEVTHDITKYSKAKVFEHIGKKTPIAVRFSTVAGESGSADTVRDPRGFAVKFYTEDGNWDLVGNNTPIFFIRDPILFPSFIHSQKRNPQTHLKDPDMVWDFWSLRPESLHQVSFLFSDRGIPDGHRHMNGYGSHTFKLVNANGEAVYCKFHYKTDQGIKNLSVEDAARLSQEDPDYGIRDLFNAIATGKYPSWTFYIQVMTFNQAETFPFNPFDLTKVWPHKDYPLIPVGKLVLNRNPVNYFAEVEQIAFDPSNMPPGIEASPDKMLQGRLFAYPDTHRHRLGPNYLHIPVNCPYRARVANYQRDGPMCMQDNQGGAPNYYPNSFGAPEQQPSALEHSIQYSGEVRRFNTANDDNVTQVRAFYVNVLNEEQRKRLCENIAGHLKDAQIFIQKKAVKNFTEVHPDYGSHIQALLDKYNAEKPKNAIHTFVQSGSHLAAREKANL

SEQ ID NO: 12396 - protein, 199 aa, Homo sapiens
  Payload ID: 2437
  Gene Symbol: COMT
  Gene Name: catechol-O-methyltransferase
  ENSP ID: ENSP00000207636
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVCRDGLLSVRTWALTGAVPGHPCGWSVPGHHPPAEEEV

SEQ ID NO: 12397 - protein, 271 aa, Homo sapiens
  Payload ID: 2437
  Gene Symbol: COMT
  Gene Name: catechol-O-methyltransferase
  Uniprot ID: P21964
  ENSP ID: ENSP00000354511
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 12398 - protein, 235 aa, Homo sapiens
  Payload ID: 2437
  Gene Symbol: COMT
  Gene Name: catechol-O-methyltransferase
  ENSP ID: ENSP00000383966
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEVSPNQDGIRASCCPEPIQSASASPKSQAFQ

SEQ ID NO: 12399 - protein, 271 aa, Homo sapiens; identical to SEQ ID NO: 12397
  Payload ID: 2437
  Gene Symbol: COMT
  Gene Name: catechol-O-methyltransferase
  Uniprot ID: P21964
  ENSP ID: ENSP00000384654

SEQ ID NO: 12400 - protein, 271 aa, Homo sapiens; identical to SEQ ID NO: 12397
  Payload ID: 2437
  Gene Symbol: COMT
  Gene Name: catechol-O-methyltransferase
  Uniprot ID: P21964
  ENSP ID: ENSP00000385150

SEQ ID NO: 12401 - protein, 271 aa, Homo sapiens; identical to SEQ ID NO: 12397
  Payload ID: 2437
  Gene Symbol: COMT
  Gene Name: catechol-O-methyltransferase
  Uniprot ID: P21964
  ENSP ID: ENSP00000385917

SEQ ID NO: 12402 - protein, 152 aa, Homo sapiens
  Payload ID: 2437
  Gene Symbol: COMT
  Gene Name: catechol-O-methyltransferase
  ENSP ID: ENSP00000387695
  MOD_RES (1)..(1): Any amino acid
XNPDCAAITQRMVDFAGVKDKVTLVVGASQDIIPQLKKKYDVDTLDMVFLDHWKDRYLPDTLLLEVQWSGVFQSADVFCIPDDQIGLLSPLAQPEKSRSPGPSLMHSLAQTGRQPPCSRPRPLSSSRVALCSTSFQLTLLGHFFFFLNENTS

SEQ ID NO: 12403 - protein, 223 aa, Homo sapiens
  Payload ID: 2437
  Gene Symbol: COMT
  Gene Name: catechol-O-methyltransferase
  ENSP ID: ENSP00000403958
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVIC

SEQ ID NO: 12404 - protein, 221 aa, Homo sapiens
  Payload ID: 2437
  Gene Symbol: COMT
  Gene Name: catechol-O-methyltransferase
  Uniprot ID: P21964
  ENSP ID: ENSP00000416778
MGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 12405 - protein, 262 aa, Homo sapiens
  Payload ID: 2438
  Gene Symbol: COMTD1
  Gene Name: catechol-O-methyltransferase domain containing 1
  Uniprot ID: Q86VU5
  ENSP ID: ENSP00000361616
MTQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 12406 - protein, 260 aa, Homo sapiens
  Payload ID: 2438
  Gene Symbol: COMTD1
  Gene Name: catechol-O-methyltransferase domain containing 1
  ENSP ID: ENSP00000473626
  MOD_RES (1)..(1): Any amino acid
XPAGAPALRARRAGPGLSRTGRRLRHWPLPGEAVPPMARPARAVPASPRGQPPVAVSSEPLHAGAPGAAKPELTLEQPQGDSMMTCEQAQLLANLARLIQAKKALDLGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 12407 - protein, 906 aa, Homo sapiens
  Payload ID: 2439
  Gene Symbol: CTNNA1
  Gene Name: catenin (cadherin-associated protein), alpha 1, 102kDa
  Uniprot ID: P35221
  ENSP ID: ENSP00000304669
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 12408 - protein, 841 aa, Homo sapiens
  Payload ID: 2439
  Gene Symbol: CTNNA1
  Gene Name: catenin (cadherin-associated protein), alpha 1, 102kDa
  ENSP ID: ENSP00000427821
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGNCDTCGALQGLKGWPPPLCWPLTGWTAPCP

SEQ ID NO: 12409 - protein, 110 aa, Homo sapiens
  Payload ID: 2439
  Gene Symbol: CTNNA1
  Gene Name: catenin (cadherin-associated protein), alpha 1, 102kDa
  ENSP ID: ENSP00000428044
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLA

SEQ ID NO: 12410 - protein, 94 aa, Homo sapiens
  Payload ID: 2439
  Gene Symbol: CTNNA1
  Gene Name: catenin (cadherin-associated protein), alpha 1, 102kDa
  ENSP ID: ENSP00000428049
MTAVHAGNINFKWDPKSLEIRTLAVERLLEPLVTQVTTLVNTNSKGPSNKKRGRSKKAHVLAASVEQATENFLEKGDKIAKESQFLKEELVAAV

SEQ ID NO: 12411 - protein, 50 aa, Homo sapiens
  Payload ID: 2439
  Gene Symbol: CTNNA1
  Gene Name: catenin (cadherin-associated protein), alpha 1, 102kDa
  ENSP ID: ENSP00000428088
MTKKTRDLRRQLRKAVMDHVSDSFLETNVPLLVLIEAAKNGNEKEVKEYA

SEQ ID NO: 12412 - protein, 101 aa, Homo sapiens
  Payload ID: 2439
  Gene Symbol: CTNNA1
  Gene Name: catenin (cadherin-associated protein), alpha 1, 102kDa
  ENSP ID: ENSP00000428202
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQG

SEQ ID NO: 12413 - protein, 117 aa, Homo sapiens
  Payload ID: 2439
  Gene Symbol: CTNNA1
  Gene Name: catenin (cadherin-associated protein), alpha 1, 102kDa
  ENSP ID: ENSP00000428439
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCS

SEQ ID NO: 12414 - protein, 22 aa, Homo sapiens
  Payload ID: 2439
  Gene Symbol: CTNNA1
  Gene Name: catenin (cadherin-associated protein), alpha 1, 102kDa
  ENSP ID: ENSP00000428686
  MOD_RES (1)..(1): Any amino acid
XVRMSASQLEALCPQRITFWKM

SEQ ID NO: 12415 - protein, 50 aa, Homo sapiens; identical to SEQ ID NO: 12411
  Payload ID: 2439
  Gene Symbol: CTNNA1
  Gene Name: catenin (cadherin-associated protein), alpha 1, 102kDa
  ENSP ID: ENSP00000428710

SEQ ID NO: 12416 - protein, 91 aa, Homo sapiens
  Payload ID: 2439
  Gene Symbol: CTNNA1
  Gene Name: catenin (cadherin-associated protein), alpha 1, 102kDa
  ENSP ID: ENSP00000428894
MTKKTRDLRRQLRKAVMDHVSDSFLETNVPLLVLIEAAKNGNEKEVKEYAQVFREHANKLIEVANLACSISNNEEGVKLVRMSASQLEALC

SEQ ID NO: 12417 - protein, 20 aa, Homo sapiens
  Payload ID: 2439
  Gene Symbol: CTNNA1
  Gene Name: catenin (cadherin-associated protein), alpha 1, 102kDa
  ENSP ID: ENSP00000429103
MTKKTRDLRRQLRKAVMDHV

SEQ ID NO: 12418 - protein, 129 aa, Homo sapiens
  Payload ID: 2439
  Gene Symbol: CTNNA1
  Gene Name: catenin (cadherin-associated protein), alpha 1, 102kDa
  ENSP ID: ENSP00000429142
KQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNQHVSIPSAVEMLIPPCIAHC

SEQ ID NO: 12419 - protein, 215 aa, Homo sapiens
  Payload ID: 2439
  Gene Symbol: CTNNA1
  Gene Name: catenin (cadherin-associated protein), alpha 1, 102kDa
  ENSP ID: ENSP00000429457
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQ

SEQ ID NO: 12420 - protein, 32 aa, Homo sapiens
  Payload ID: 2439
  Gene Symbol: CTNNA1
  Gene Name: catenin (cadherin-associated protein), alpha 1, 102kDa
  ENSP ID: ENSP00000429569
MTKKTRDLRRQLRKAVMDHVSDSFLETNVPLL

SEQ ID NO: 12421 - protein, 123 aa, Homo sapiens
  Payload ID: 2439
  Gene Symbol: CTNNA1
  Gene Name: catenin (cadherin-associated protein), alpha 1, 102kDa
  ENSP ID: ENSP00000429636
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGN

SEQ ID NO: 12422 - protein, 75 aa, Homo sapiens
  Payload ID: 2439
  Gene Symbol: CTNNA1
  Gene Name: catenin (cadherin-associated protein), alpha 1, 102kDa
  ENSP ID: ENSP00000429738
MTKKTRDLRRQLRKAVMDHVSDSFLETNVPLLVLIEAAKNGNEKEVKEYAQVFREHANKLIEVANLACSISNNEE

SEQ ID NO: 12423 - protein, 136 aa, Homo sapiens
  Payload ID: 2439
  Gene Symbol: CTNNA1
  Gene Name: catenin (cadherin-associated protein), alpha 1, 102kDa
  ENSP ID: ENSP00000430076
MTDFTRGKGPLKNTSDVISAAKKIAEAGSRMDKLGRTIADHVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 12424 - protein, 139 aa, Homo sapiens
  Payload ID: 2439
  Gene Symbol: CTNNA1
  Gene Name: catenin (cadherin-associated protein), alpha 1, 102kDa
  ENSP ID: ENSP00000430078
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLL

SEQ ID NO: 12425 - protein, 39 aa, Homo sapiens
  Payload ID: 2439
  Gene Symbol: CTNNA1
  Gene Name: catenin (cadherin-associated protein), alpha 1, 102kDa
  ENSP ID: ENSP00000430177
MTKKTRDLRRQLRKAVMDHVSDSFLETNVPLLVLIEAAK

SEQ ID NO: 12426 - protein, 128 aa, Homo sapiens
  Payload ID: 2439
  Gene Symbol: CTNNA1
  Gene Name: catenin (cadherin-associated protein), alpha 1, 102kDa
  ENSP ID: ENSP00000430240
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVL

SEQ ID NO: 12427 - protein, 156 aa, Homo sapiens
  Payload ID: 2439
  Gene Symbol: CTNNA1
  Gene Name: catenin (cadherin-associated protein), alpha 1, 102kDa
  ENSP ID: ENSP00000430304
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKV

SEQ ID NO: 12428 - protein, 105 aa, Homo sapiens
  Payload ID: 2439
  Gene Symbol: CTNNA1
  Gene Name: catenin (cadherin-associated protein), alpha 1, 102kDa
  ENSP ID: ENSP00000430379
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKP

SEQ ID NO: 12429 - protein, 40 aa, Homo sapiens
  Payload ID: 2439
  Gene Symbol: CTNNA1
  Gene Name: catenin (cadherin-associated protein), alpha 1, 102kDa
  ENSP ID: ENSP00000430623
MTKKTRDLRRQLRKAVMDHVSDSFLETNVPLLVLIEAAKN

SEQ ID NO: 12430 - protein, 161 aa, Homo sapiens
  Payload ID: 2439
  Gene Symbol: CTNNA1
  Gene Name: catenin (cadherin-associated protein), alpha 1, 102kDa
  ENSP ID: ENSP00000430626
MKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATAS

SEQ ID NO: 12431 - protein, 55 aa, Homo sapiens
  Payload ID: 2439
  Gene Symbol: CTNNA1
  Gene Name: catenin (cadherin-associated protein), alpha 1, 102kDa
  ENSP ID: ENSP00000430671
MTAVHAGNINFKWDPKSLEIRTLAVERLLEPLVTQILHLSSEGKPKKGGVWILDC

SEQ ID NO: 12432 - protein, 36 aa, Homo sapiens
  Payload ID: 2439
  Gene Symbol: CTNNA1
  Gene Name: catenin (cadherin-associated protein), alpha 1, 102kDa
  ENSP ID: ENSP00000430841
MTKKTRDLRRQLRKAVMDHVSDSFLETNVPLLVLIE

SEQ ID NO: 12433 - protein, 71 aa, Homo sapiens
  Payload ID: 2439
  Gene Symbol: CTNNA1
  Gene Name: catenin (cadherin-associated protein), alpha 1, 102kDa
  ENSP ID: ENSP00000430981
MTKKTRDLRRQLRKAVMDHVSDSFLETNVPLLVLIEAAKNGNEKEVKEYAQVFREHANKLIEVANLACSIS

SEQ ID NO: 12434 - protein, 37 aa, Homo sapiens
  Payload ID: 2439
  Gene Symbol: CTNNA1
  Gene Name: catenin (cadherin-associated protein), alpha 1, 102kDa
  ENSP ID: ENSP00000431033
MTAVHAGNINFKWDPKSLEIRTLAVERLLEPLVTQVI

SEQ ID NO: 12435 - protein, 119 aa, Homo sapiens
  Payload ID: 2439
  Gene Symbol: CTNNA1
  Gene Name: catenin (cadherin-associated protein), alpha 1, 102kDa
  ENSP ID: ENSP00000431118
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKE

SEQ ID NO: 12436 - protein, 536 aa, Homo sapiens
  Payload ID: 2439
  Gene Symbol: CTNNA1
  Gene Name: catenin (cadherin-associated protein), alpha 1, 102kDa
  Uniprot ID: P35221
  ENSP ID: ENSP00000438476
MTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 12437 - protein, 64 aa, Homo sapiens
  Payload ID: 2439
  Gene Symbol: CTNNA1
  Gene Name: catenin (cadherin-associated protein), alpha 1, 102kDa
  ENSP ID: ENSP00000482738
MTKKTRDLRRQLRKAVMDHVSDSFLETNVPLLVLIEAAKNGNEKEVKEYAQVFREHANKLIEGI

SEQ ID NO: 12438 - protein, 841 aa, Homo sapiens; identical to SEQ ID NO: 12408
  Payload ID: 2439
  Gene Symbol: CTNNA1
  Gene Name: catenin (cadherin-associated protein), alpha 1, 102kDa
  ENSP ID: ENSP00000486200

SEQ ID NO: 12439 - protein, 584 aa, Homo sapiens
  Payload ID: 2440
  Gene Symbol: CTNNA2
  Gene Name: catenin (cadherin-associated protein), alpha 2
  Uniprot ID: P26232
  ENSP ID: ENSP00000341500
MDGWRRPLQSVGKVCEKNMKTSEMHTMSGAQTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12440 - protein, 569 aa, Homo sapiens
  Payload ID: 2440
  Gene Symbol: CTNNA2
  Gene Name: catenin (cadherin-associated protein), alpha 2
  ENSP ID: ENSP00000355398
MDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGTGVQSTFTTFYEVDCDVIDGGRASQLSTHLPTCAEGAPIGSGSSDSSMLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12441 - protein, 953 aa, Homo sapiens
  Payload ID: 2440
  Gene Symbol: CTNNA2
  Gene Name: catenin (cadherin-associated protein), alpha 2
  Uniprot ID: P26232
  ENSP ID: ENSP00000384638
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGTGVQSTFTTFYEVDCDVIDGGRASQLSTHLPTCAEGAPIGSGSSDSSMLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12442 - protein, 190 aa, Homo sapiens
  Payload ID: 2440
  Gene Symbol: CTNNA2
  Gene Name: catenin (cadherin-associated protein), alpha 2
  ENSP ID: ENSP00000386587
MRKLHWNLSCGDFKLCETGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCV

SEQ ID NO: 12443 - protein, 117 aa, Homo sapiens
  Payload ID: 2440
  Gene Symbol: CTNNA2
  Gene Name: catenin (cadherin-associated protein), alpha 2
  ENSP ID: ENSP00000387073
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSS

SEQ ID NO: 12444 - protein, 44 aa, Homo sapiens
  Payload ID: 2440
  Gene Symbol: CTNNA2
  Gene Name: catenin (cadherin-associated protein), alpha 2
  ENSP ID: ENSP00000387232
MTSATSPIILKWDPKSLEIRTLTVERLLEPLVTQCIFFSTGYFK

SEQ ID NO: 12445 - protein, 66 aa, Homo sapiens
  Payload ID: 2440
  Gene Symbol: CTNNA2
  Gene Name: catenin (cadherin-associated protein), alpha 2
  ENSP ID: ENSP00000400105
MTSATSPIILKWDPKSLEIRTLTVERLLEPLVTQVTTLVNTSNKGPSGKKKGRSKKAHVLAASVEQ

SEQ ID NO: 12446 - protein, 905 aa, Homo sapiens
  Payload ID: 2440
  Gene Symbol: CTNNA2
  Gene Name: catenin (cadherin-associated protein), alpha 2
  Uniprot ID: P26232
  ENSP ID: ENSP00000418191
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12447 - protein, 905 aa, Homo sapiens; identical to SEQ ID NO: 12446
  Payload ID: 2440
  Gene Symbol: CTNNA2
  Gene Name: catenin (cadherin-associated protein), alpha 2
  Uniprot ID: P26232
  ENSP ID: ENSP00000419295

SEQ ID NO: 12448 - protein, 476 aa, Homo sapiens
  Payload ID: 2440
  Gene Symbol: CTNNA2
  Gene Name: catenin (cadherin-associated protein), alpha 2
  ENSP ID: ENSP00000441705
MDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12449 - protein, 537 aa, Homo sapiens
  Payload ID: 2440
  Gene Symbol: CTNNA2
  Gene Name: catenin (cadherin-associated protein), alpha 2
  Uniprot ID: P26232
  ENSP ID: ENSP00000444675
MTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12450 - protein, 860 aa, Homo sapiens
  Payload ID: 2440
  Gene Symbol: CTNNA2
  Gene Name: catenin (cadherin-associated protein), alpha 2
  Uniprot ID: P26232
  ENSP ID: ENSP00000486160
MTSATSPIILKWDPKSLEIRTLTVERLLEPLVTQVTTLVNTSNKGPSGKKKGRSKKAHVLAASVEQATQNFLEKGEQIAKESQDLKEELVAAVEDVRKQGETMRIASSEFADDPCSSVKRGTMVRAARALLSAVTRLLILADMADVMRLLSHLKIVEEALEAVKNATNEQDLANRFKEFGKEMVKLNYVAARRQQELKDPHCRDEMAAARGALKKNATMLYTASQAFLRHPDVAATRANRDYVFKQVQEAIAGISNAAQATSPTDEAKGHTGIGELAAALNEFDNKIILDPMTFSEARFRPSLEERLESIISGAALMADSSCTRDDRRERIVAECNAVRQALQDLLSEYMNNTGRKEKGDPLNIAIDKMTKKTRDLRRQLRKAVMDHISDSFLETNVPLLVLIEAAKSGNEKEVKEYAQVFREHANKLVEVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 12451 - protein, 193 aa, Homo sapiens
  Payload ID: 2441
  Gene Symbol: CTNNA3
  Gene Name: catenin (cadherin-associated protein), alpha 3
  ENSP ID: ENSP00000330570
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQ

SEQ ID NO: 12452 - protein, 895 aa, Homo sapiens
  Payload ID: 2441
  Gene Symbol: CTNNA3
  Gene Name: catenin (cadherin-associated protein), alpha 3
  Uniprot ID: Q9UI47
  ENSP ID: ENSP00000389714
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVANLACSMSTNEDGIKIVKIAANHLETLCPQIINAALALAARPKSQAVKNTMEMYKRTWENHIHVLTEAVDDITSIDDFLAVSESHILEDVNKCIIALRDQDADNLDRAAGAIRGRAARVAHIVTGEMDSYEPGAYTEGVMRNVNFLTSTVIPEFVTQVNVALEALSKSSLNVLDDNQFVDISKKIYDTIHDIRCSVMMIRTPEELEDVSDLEEEHEVRSHTSIQTEGKTDRAKMTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 12453 - protein, 184 aa, Homo sapiens
  Payload ID: 2441
  Gene Symbol: CTNNA3
  Gene Name: catenin (cadherin-associated protein), alpha 3
  ENSP ID: ENSP00000441444
QDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNLCNQKSDLGLTGVKIKLLEECIIFWSL

SEQ ID NO: 12454 - protein, 127 aa, Homo sapiens
  Payload ID: 2441
  Gene Symbol: CTNNA3
  Gene Name: catenin (cadherin-associated protein), alpha 3
  ENSP ID: ENSP00000477144
  MOD_RES (1)..(1): Any amino acid
XISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVSMLEL

SEQ ID NO: 12455 - protein, 734 aa, Homo sapiens
  Payload ID: 2442
  Gene Symbol: CTNNAL1
  Gene Name: catenin (cadherin-associated protein), alpha-like 1
  Uniprot ID: Q9UBT7
  ENSP ID: ENSP00000320434
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 12456 - protein, 183 aa, Homo sapiens
  Payload ID: 2442
  Gene Symbol: CTNNAL1
  Gene Name: catenin (cadherin-associated protein), alpha-like 1
  ENSP ID: ENSP00000363721
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKRLTIYNLRHS

SEQ ID NO: 12457 - protein, 135 aa, Homo sapiens
  Payload ID: 2442
  Gene Symbol: CTNNAL1
  Gene Name: catenin (cadherin-associated protein), alpha-like 1
  ENSP ID: ENSP00000363722
MSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 12458 - protein, 718 aa, Homo sapiens
  Payload ID: 2442
  Gene Symbol: CTNNAL1
  Gene Name: catenin (cadherin-associated protein), alpha-like 1
  Uniprot ID: Q9UBT7
  ENSP ID: ENSP00000363723
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKSETRY

SEQ ID NO: 12459 - protein, 781 aa, Homo sapiens
  Payload ID: 2443
  Gene Symbol: CTNNB1
  Gene Name: catenin (cadherin-associated protein), beta 1, 88kDa
  Uniprot ID: P35222
  ENSP ID: ENSP00000344456
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 12460 - protein, 781 aa, Homo sapiens; identical to SEQ ID NO: 12459
  Payload ID: 2443
  Gene Symbol: CTNNB1
  Gene Name: catenin (cadherin-associated protein), beta 1, 88kDa
  Uniprot ID: P35222
  ENSP ID: ENSP00000379486

SEQ ID NO: 12461 - protein, 781 aa, Homo sapiens; identical to SEQ ID NO: 12459
  Payload ID: 2443
  Gene Symbol: CTNNB1
  Gene Name: catenin (cadherin-associated protein), beta 1, 88kDa
  Uniprot ID: P35222
  ENSP ID: ENSP00000379488

SEQ ID NO: 12462 - protein, 781 aa, Homo sapiens; identical to SEQ ID NO: 12459
  Payload ID: 2443
  Gene Symbol: CTNNB1
  Gene Name: catenin (cadherin-associated protein), beta 1, 88kDa
  Uniprot ID: P35222
  ENSP ID: ENSP00000385604

SEQ ID NO: 12463 - protein, 13 aa, Homo sapiens
  Payload ID: 2443
  Gene Symbol: CTNNB1
  Gene Name: catenin (cadherin-associated protein), beta 1, 88kDa
  ENSP ID: ENSP00000387455
MATQADLMELDMA

SEQ ID NO: 12464 - protein, 59 aa, Homo sapiens
  Payload ID: 2443
  Gene Symbol: CTNNB1
  Gene Name: catenin (cadherin-associated protein), beta 1, 88kDa
  ENSP ID: ENSP00000400508
MELDMAMEPDRKAAVSHWQQQSYLDSGIHSGATTTAPSLSGKGNPEEEDVDTSQVLYEW

SEQ ID NO: 12465 - protein, 100 aa, Homo sapiens
  Payload ID: 2443
  Gene Symbol: CTNNB1
  Gene Name: catenin (cadherin-associated protein), beta 1, 88kDa
  ENSP ID: ENSP00000401599
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFP

SEQ ID NO: 12466 - protein, 108 aa, Homo sapiens
  Payload ID: 2443
  Gene Symbol: CTNNB1
  Gene Name: catenin (cadherin-associated protein), beta 1, 88kDa
  ENSP ID: ENSP00000409302
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQ

SEQ ID NO: 12467 - protein, 774 aa, Homo sapiens
  Payload ID: 2443
  Gene Symbol: CTNNB1
  Gene Name: catenin (cadherin-associated protein), beta 1, 88kDa
  ENSP ID: ENSP00000411226
MELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 12468 - protein, 149 aa, Homo sapiens
  Payload ID: 2443
  Gene Symbol: CTNNB1
  Gene Name: catenin (cadherin-associated protein), beta 1, 88kDa
  ENSP ID: ENSP00000412219
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELA

SEQ ID NO: 12469 - protein, 933 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000351527
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12470 - protein, 941 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000354785
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 12471 - protein, 962 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000354823
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12472 - protein, 939 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000354907
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12473 - protein, 968 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000382004
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12474 - protein, 867 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000403518
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12475 - protein, 832 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000409930
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12476 - protein, 933 aa, Homo sapiens; identical to SEQ ID NO: 12469
  Payload ID: 2444
  Gene Symbol: CTNND1
  Gene Name: catenin (cadherin-associated protein), delta 1
  Uniprot ID: O60716
  ENSP ID: ENSP00000413586

SEQ ID NO: 12477 - protein, 123 aa, Homo sapiens
  Payload ID: 2444
  Gene Symbol: CTNND1
  Gene Name: catenin (cadherin-associated protein), delta 1
  ENSP ID: ENSP00000431208
  MOD_RES (1)..(1): Any amino acid
XVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMVNSLYILLSV

SEQ ID NO: 12478 - protein, 128 aa, Homo sapiens
  Payload ID: 2444
  Gene Symbol: CTNND1
  Gene Name: catenin (cadherin-associated protein), delta 1
  ENSP ID: ENSP00000431600
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDF

SEQ ID NO: 12479 - protein, 918 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000432041
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQKI

SEQ ID NO: 12480 - protein, 832 aa, Homo sapiens; identical to SEQ ID NO: 12475
  Payload ID: 2444
  Gene Symbol: CTNND1
  Gene Name: catenin (cadherin-associated protein), delta 1
  Uniprot ID: O60716
  ENSP ID: ENSP00000432075

SEQ ID NO: 12481 - protein, 879 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000432243
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12482 - protein, 4 aa, Homo sapiens
  Payload ID: 2444
  Gene Symbol: CTNND1
  Gene Name: catenin (cadherin-associated protein), delta 1
  ENSP ID: ENSP00000432299
MDDS

SEQ ID NO: 12483 - protein, 639 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000432623
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12484 - protein, 610 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000433158
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12485 - protein, 914 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000433276
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12486 - protein, 908 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000433334
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12487 - protein, 832 aa, Homo sapiens; identical to SEQ ID NO: 12475
  Payload ID: 2444
  Gene Symbol: CTNND1
  Gene Name: catenin (cadherin-associated protein), delta 1
  Uniprot ID: O60716
  ENSP ID: ENSP00000434017

SEQ ID NO: 12488 - protein, 261 aa, Homo sapiens
  Payload ID: 2444
  Gene Symbol: CTNND1
  Gene Name: catenin (cadherin-associated protein), delta 1
  ENSP ID: ENSP00000434202
MANGTLTRRHQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPL

SEQ ID NO: 12489 - protein, 616 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000434672
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12490 - protein, 938 aa, Homo sapiens
  Payload ID: 2444
  Gene Symbol: CTNND1
  Gene Name: catenin (cadherin-associated protein), delta 1
  ENSP ID: ENSP00000434808
MDDSEVESTASILASVKEQEAQFEKLTRALEEERRHVSAQLERVRVSPQDANPLMANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMKI

SEQ ID NO: 12491 - protein, 645 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000434900
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12492 - protein, 840 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000434949
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 12493 - protein, 126 aa, Homo sapiens
  Payload ID: 2444
  Gene Symbol: CTNND1
  Gene Name: catenin (cadherin-associated protein), delta 1
  ENSP ID: ENSP00000435242
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKN

SEQ ID NO: 12494 - protein, 838 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000435266
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12495 - protein, 879 aa, Homo sapiens; identical to SEQ ID NO: 12481
  Payload ID: 2444
  Gene Symbol: CTNND1
  Gene Name: catenin (cadherin-associated protein), delta 1
  Uniprot ID: O60716
  ENSP ID: ENSP00000435379

SEQ ID NO: 12496 - protein, 887 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000435494
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 12497 - protein, 879 aa, Homo sapiens; identical to SEQ ID NO: 12481
  Payload ID: 2444
  Gene Symbol: CTNND1
  Gene Name: catenin (cadherin-associated protein), delta 1
  Uniprot ID: O60716
  ENSP ID: ENSP00000435789

SEQ ID NO: 12498 - protein, 879 aa, Homo sapiens; identical to SEQ ID NO: 12481
  Payload ID: 2444
  Gene Symbol: CTNND1
  Gene Name: catenin (cadherin-associated protein), delta 1
  Uniprot ID: O60716
  ENSP ID: ENSP00000436323

SEQ ID NO: 12499 - protein, 933 aa, Homo sapiens; identical to SEQ ID NO: 12469
  Payload ID: 2444
  Gene Symbol: CTNND1
  Gene Name: catenin (cadherin-associated protein), delta 1
  Uniprot ID: O60716
  ENSP ID: ENSP00000436543

SEQ ID NO: 12500 - protein, 885 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000436744
MANGTLTRRHQNGRFVGDADLERQKFSDLKLNGPQDHSHLLYSTIPRMQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKDEWFSRGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQKI

SEQ ID NO: 12501 - protein, 618 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000437051
MIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 12502 - protein, 832 aa, Homo sapiens; identical to SEQ ID NO: 12475
  Payload ID: 2444
  Gene Symbol: CTNND1
  Gene Name: catenin (cadherin-associated protein), delta 1
  Uniprot ID: O60716
  ENSP ID: ENSP00000437156

SEQ ID NO: 12503 - protein, 861 aa, Homo sapiens
  Payload ID: 2444
  Gene Symbol: CTNND1
  Gene Name: catenin (cadherin-associated protein), delta 1
  Uniprot ID: O60716
  ENSP ID: ENSP00000437327
MQEPGQIVETYTEEDPEGAMSVVSVETSDDGTTRRTETTVKKVVKTVTTRTVQPVAMGPDGLPVDASSVSNNYIQTLGRDFRKNGNGGPGPYVGQAGTATLPRNFHYPPDGYSRHYEDGYPGGSDNYGSLSRVTRIEERYRPSMEGYRAPSRQDVYGPQPQVRVGGSSVDLHRFHPEPYGLEDDQRSMGYDDLDYGMMSDYGTARRTGTPSDPRRRLRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDKKPDREEIQMSNMGSNTKSLDNNYSTPNERGDHNRTLDRSGDLGDMEPLKGTTPLMQDEGQESLEEELDVLVLDDEGGQVSYPSMQKI

SEQ ID NO: 12504 - protein, 1225 aa, Homo sapiens
  Payload ID: 2445
  Gene Symbol: CTNND2
  Gene Name: catenin (cadherin-associated protein), delta 2
  Uniprot ID: Q9UQB3
  ENSP ID: ENSP00000307134
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 12505 - protein, 320 aa, Homo sapiens [sequence omitted]

SEQ ID NO: 12506 - protein, 231 aa, Homo sapiens
  Payload ID: 2445
  Gene Symbol: CTNND2
  Gene Name: catenin (cadherin-associated protein), delta 2
  ENSP ID: ENSP00000421000
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQLVPEPHTAASMGTWAQSCGPCSPQNTT

SEQ ID NO: 12507 - protein, 912 aa, Homo sapiens
  Payload ID: 2445
  Gene Symbol: CTNND2
  Gene Name: catenin (cadherin-associated protein), delta 2
  ENSP ID: ENSP00000421093
MFARKPPGAAPLGAMPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGETGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKGWAEDVAGMAYALRSLPEGAPCLPQWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTGAHSASMCRPYKGTPQRCS

SEQ ID NO: 12508 - protein, 209 aa, Homo sapiens
  Payload ID: 2445
  Gene Symbol: CTNND2
  Gene Name: catenin (cadherin-associated protein), delta 2
  ENSP ID: ENSP00000422389
MPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGETGSRASYSSQHGHLGPELRALQSPEHHIDPIYEDRVYQKPPMRSLSQSQGDPLPPAHTGTYRTSTAPSSPGVDSVPL

SEQ ID NO: 12509 - protein, 169 aa, Homo sapiens
  Payload ID: 2445
  Gene Symbol: CTNND2
  Gene Name: catenin (cadherin-associated protein), delta 2
  ENSP ID: ENSP00000424296
MPVPDQPSSASEKTSSLSPGLNTSNGDGSETETTSAILASVKEQELQFERLTRELEAERQIVASQLERCKLGSETGSMSSMSSAEEQFQWQSQDGQKDIEDELTTGLELVDSCIRSLQESGILDPQDYSTGERPSLLSQSALQLNSKPEGSFQYPASYHSNQTLALGET

SEQ ID NO: 12510 - protein, 1134 aa, Homo sapiens
  Payload ID: 2445
  Gene Symbol: CTNND2
  Gene Name: catenin (cadherin-associated protein), delta 2
  ENSP ID: ENSP00000426510
MSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAPQGGSPTKLQRGGSAPEGATYAAPRGSSPKQSPSRLAKSYSTSSPINIVVSSAGLSPIRVTSPPTVQSTISSSPIHQLSSTIGTYATLSPTKRLVHASEQYSKHSQELYATATLQRPGSLAAGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 12511 - protein, 181 aa, Homo sapiens
  Payload ID: 2445
  Gene Symbol: CTNND2
  Gene Name: catenin (cadherin-associated protein), delta 2
  ENSP ID: ENSP00000426625
MSSMSSAEEQFQWQSQDGQKDIEDELTTGLELVDSCIRSLQESGILDPQDYSTGERPSLLSQSALQLNSKPEGSFQYPASYHSNQTLALGETTPSQLPARGTQARATGQSFSQGTTSRAGHLAGPEPAPPPPPPPREPFAPSLGSAFHLPDAPPAAAAAALYYSSSTLPAPPRGGSPLAAP

SEQ ID NO: 12512 - protein, 888 aa, Homo sapiens
  Payload ID: 2445
  Gene Symbol: CTNND2
  Gene Name: catenin (cadherin-associated protein), delta 2
  ENSP ID: ENSP00000426887
MSSMSSAEEQFQWQSQDGQKDIEDELTTGLELVDSCIRSLQESGILDPQDYSTGETGSRASYSSQHGHLGPELRALQSPEHHIDPIYEDRVYQKPPMRSLSQSQGDPLPPAHTGTYRTSTAPSSPGVDSVPLQRTGSQHGPQNAAAATFQRASYAAGPASNYADPYRQLQYCPSVESPYSKSGPALPPEGTLARSPSIDSIQKDPREFGWRDPELPEVIQMLQHQFPSVQSNAAAYLQHLCFGDNKIKAEIRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 12513 - protein, 81 aa, Homo sapiens
  Payload ID: 2446
  Gene Symbol: CTNNBIP1
  Gene Name: catenin, beta interacting protein 1
  Uniprot ID: Q9NSA3
  ENSP ID: ENSP00000366466
MNREGAPGKSPEEMYIQQKVRVLLMLRKMGSNLTASEEEFLRTYAGVVNSQLSQLPPHSIDQGAEDVVMAFSRSETEDRRQ

SEQ ID NO: 12514 - protein, 81 aa, Homo sapiens; identical to SEQ ID NO: 12513
  Payload ID: 2446
  Gene Symbol: CTNNBIP1
  Gene Name: catenin, beta interacting protein 1
  Uniprot ID: Q9NSA3
  ENSP ID: ENSP00000366468

SEQ ID NO: 12515 - protein, 81 aa, Homo sapiens; identical to SEQ ID NO: 12513
  Payload ID: 2446
  Gene Symbol: CTNNBIP1
  Gene Name: catenin, beta interacting protein 1
  Uniprot ID: Q9NSA3
  ENSP ID: ENSP00000366474

SEQ ID NO: 12516 - protein, 81 aa, Homo sapiens; identical to SEQ ID NO: 12513
  Payload ID: 2446
  Gene Symbol: CTNNBIP1
  Gene Name: catenin, beta interacting protein 1
  Uniprot ID: Q9NSA3
  ENSP ID: ENSP00000383696

SEQ ID NO: 12517 - protein, 563 aa, Homo sapiens
  Payload ID: 2447
  Gene Symbol: CTNNBL1
  Gene Name: catenin, beta like 1
  Uniprot ID: Q8WYA6
  ENSP ID: ENSP00000355050
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 12518 - protein, 311 aa, Homo sapiens
  Payload ID: 2447
  Gene Symbol: CTNNBL1
  Gene Name: catenin, beta like 1
  Uniprot ID: Q8WYA6
  ENSP ID: ENSP00000362568
MPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 12519 - protein, 376 aa, Homo sapiens
  Payload ID: 2447
  Gene Symbol: CTNNBL1
  Gene Name: catenin, beta like 1
  Uniprot ID: Q8WYA6
  ENSP ID: ENSP00000362572
MVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 12520 - protein, 536 aa, Homo sapiens
  Payload ID: 2447
  Gene Symbol: CTNNBL1
  Gene Name: catenin, beta like 1
  Uniprot ID: Q8WYA6
  ENSP ID: ENSP00000384355
MRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 12521 - protein, 166 aa, Homo sapiens
  Payload ID: 2447
  Gene Symbol: CTNNBL1
  Gene Name: catenin, beta like 1
  ENSP ID: ENSP00000394464
MRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQV

SEQ ID NO: 12522 - protein, 568 aa, Homo sapiens
  Payload ID: 2447
  Gene Symbol: CTNNBL1
  Gene Name: catenin, beta like 1
  ENSP ID: ENSP00000478532
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDILSDLTSVAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 12523 - protein, 536 aa, Homo sapiens; identical to SEQ ID NO: 12520
  Payload ID: 2447
  Gene Symbol: CTNNBL1
  Gene Name: catenin, beta like 1
  Uniprot ID: Q8WYA6
  ENSP ID: ENSP00000487198

SEQ ID NO: 12524 - protein, 173 aa, Homo sapiens
  Payload ID: 2448
  Gene Symbol: CAMP
  Gene Name: cathelicidin antimicrobial peptide
  ENSP ID: ENSP00000296435
MGTMKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 12525 - protein, 480 aa, Homo sapiens
  Payload ID: 2449
  Gene Symbol: CTSA
  Gene Name: cathepsin A
  Uniprot ID: P10619
  ENSP ID: ENSP00000191018
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 12526 - protein, 481 aa, Homo sapiens
  Payload ID: 2449
  Gene Symbol: CTSA
  Gene Name: cathepsin A
  ENSP ID: ENSP00000346952
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 12527 - protein, 480 aa, Homo sapiens; identical to SEQ ID NO: 12525
  Payload ID: 2449
  Gene Symbol: CTSA
  Gene Name: cathepsin A
  Uniprot ID: P10619
  ENSP ID: ENSP00000361537

SEQ ID NO: 12528 - protein, 498 aa, Homo sapiens
  Payload ID: 2449
  Gene Symbol: CTSA
  Gene Name: cathepsin A
  ENSP ID: ENSP00000361562
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 12529 - protein, 202 aa, Homo sapiens
  Payload ID: 2449
  Gene Symbol: CTSA
  Gene Name: cathepsin A
  ENSP ID: ENSP00000408533
QDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRTLLWSRIWATSSLACHSSGCGIRHCCAQGIKCAWTPPAPTQQLLPPTSTTRTCGRPSTSRSSCHNGTCA

SEQ ID NO: 12530 - protein, 109 aa, Homo sapiens
  Payload ID: 2449
  Gene Symbol: CTSA
  Gene Name: cathepsin A
  ENSP ID: ENSP00000475524
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVT

SEQ ID NO: 12531 - protein, 82 aa, Homo sapiens
  Payload ID: 2449
  Gene Symbol: CTSA
  Gene Name: cathepsin A
  ENSP ID: ENSP00000475827
MTSSPRAPPGEQGRGGAEMIRAAPPPLFLLLLLLLLLVSWASRGEAAPDQDEIQRLPGLAKQPSFRQYSGYLKGSGSKHLHY

SEQ ID NO: 12532 - protein, 231 aa, Homo sapiens
  Payload ID: 2449
  Gene Symbol: CTSA
  Gene Name: cathepsin A
  ENSP ID: ENSP00000476235
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQVQGAGCGQWTLLL

SEQ ID NO: 12533 - protein, 339 aa, Homo sapiens
  Payload ID: 2450
  Gene Symbol: CTSB
  Gene Name: cathepsin B
  Uniprot ID: P07858
  ENSP ID: ENSP00000342070
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 12534 - protein, 339 aa, Homo sapiens; identical to SEQ ID NO: 12533
  Payload ID: 2450
  Gene Symbol: CTSB
  Gene Name: cathepsin B
  Uniprot ID: P07858
  ENSP ID: ENSP00000345672

SEQ ID NO: 12535 - protein, 339 aa, Homo sapiens; identical to SEQ ID NO: 12533
  Payload ID: 2450
  Gene Symbol: CTSB
  Gene Name: cathepsin B
  Uniprot ID: P07858
  ENSP ID: ENSP00000409917

SEQ ID NO: 12536 - protein, 70 aa, Homo sapiens
  Payload ID: 2450
  Gene Symbol: CTSB
  Gene Name: cathepsin B
  ENSP ID: ENSP00000431143
MWQLWASLCCLLVLANARSRPSFHPLSDELVNYVNKRNTTWQAGHNFYNVDMSYLKRLCGTFLGGPKPPQ

SEQ ID NO: 12537 - protein, 136 aa, Homo sapiens
  Payload ID: 2450
  Gene Symbol: CTSB
  Gene Name: cathepsin B
  ENSP ID: ENSP00000431518
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAE

SEQ ID NO: 12538 - protein, 32 aa, Homo sapiens
  Payload ID: 2450
  Gene Symbol: CTSB
  Gene Name: cathepsin B
  ENSP ID: ENSP00000432077
MWQLWASLCCLLVLANARSRPSFHPLSDELVN

SEQ ID NO: 12539 - protein, 339 aa, Homo sapiens; identical to SEQ ID NO: 12533
  Payload ID: 2450
  Gene Symbol: CTSB
  Gene Name: cathepsin B
  Uniprot ID: P07858
  ENSP ID: ENSP00000432244

SEQ ID NO: 12540 - protein, 20 aa, Homo sapiens
  Payload ID: 2450
  Gene Symbol: CTSB
  Gene Name: cathepsin B
  ENSP ID: ENSP00000432408
MWQLWASLCCLLVLANARSR

SEQ ID NO: 12541 - protein, 339 aa, Homo sapiens; identical to SEQ ID NO: 12533
  Payload ID: 2450
  Gene Symbol: CTSB
  Gene Name: cathepsin B
  Uniprot ID: P07858
  ENSP ID: ENSP00000433215

SEQ ID NO: 12542 - protein, 68 aa, Homo sapiens
  Payload ID: 2450
  Gene Symbol: CTSB
  Gene Name: cathepsin B
  ENSP ID: ENSP00000433379
MWQLWASLCCLLVLANARSRPSFHPLSDELVNYVNKRNTTWQAGHNFYNVDMSYLKRLCGTFLGGPKP

SEQ ID NO: 12543 - protein, 55 aa, Homo sapiens
  Payload ID: 2450
  Gene Symbol: CTSB
  Gene Name: cathepsin B
  ENSP ID: ENSP00000433929
MWQLWASLCCLLVLANARSRPSFHPLSDELVNYVNKRNTTWQAGHNFYNVDMSYL

SEQ ID NO: 12544 - protein, 170 aa, Homo sapiens
  Payload ID: 2450
  Gene Symbol: CTSB
  Gene Name: cathepsin B
  ENSP ID: ENSP00000433995
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSG

SEQ ID NO: 12545 - protein, 339 aa, Homo sapiens; identical to SEQ ID NO: 12533
  Payload ID: 2450
  Gene Symbol: CTSB
  Gene Name: cathepsin B
  Uniprot ID: P07858
  ENSP ID: ENSP00000434217

SEQ ID NO: 12546 - protein, 143 aa, Homo sapiens
  Payload ID: 2450
  Gene Symbol: CTSB
  Gene Name: cathepsin B
  ENSP ID: ENSP00000434725
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCG

SEQ ID NO: 12547 - protein, 165 aa, Homo sapiens
  Payload ID: 2450
  Gene Symbol: CTSB
  Gene Name: cathepsin B
  ENSP ID: ENSP00000435074
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRK

SEQ ID NO: 12548 - protein, 339 aa, Homo sapiens; identical to SEQ ID NO: 12533
  Payload ID: 2450
  Gene Symbol: CTSB
  Gene Name: cathepsin B
  Uniprot ID: P07858
  ENSP ID: ENSP00000435105

SEQ ID NO: 12549 - protein, 70 aa, Homo sapiens; identical to SEQ ID NO: 12536
  Payload ID: 2450
  Gene Symbol: CTSB
  Gene Name: cathepsin B
  ENSP ID: ENSP00000435260

SEQ ID NO: 12550 - protein, 101 aa, Homo sapiens
  Payload ID: 2450
  Gene Symbol: CTSB
  Gene Name: cathepsin B
  ENSP ID: ENSP00000435650
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRD

SEQ ID NO: 12551 - protein, 92 aa, Homo sapiens
  Payload ID: 2450
  Gene Symbol: CTSB
  Gene Name: cathepsin B
  ENSP ID: ENSP00000435886
MWQLWASLCCLLVLANARSRPSFHPLSDELVNYVNKRNTTWQAGHNFYNVDMSYLKRLCGTFLGGPKPPQRVMFTEDLKLPASFDAREQWPQ

SEQ ID NO: 12552 - protein, 98 aa, Homo sapiens
  Payload ID: 2450
  Gene Symbol: CTSB
  Gene Name: cathepsin B
  ENSP ID: ENSP00000436074
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKE

SEQ ID NO: 12553 - protein, 143 aa, Homo sapiens; identical to SEQ ID NO: 12546
  Payload ID: 2450
  Gene Symbol: CTSB
  Gene Name: cathepsin B
  ENSP ID: ENSP00000436122

SEQ ID NO: 12554 - protein, 175 aa, Homo sapiens
  Payload ID: 2450
  Gene Symbol: CTSB
  Gene Name: cathepsin B
  ENSP ID: ENSP00000436159
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYES

SEQ ID NO: 12555 - protein, 110 aa, Homo sapiens
  Payload ID: 2450
  Gene Symbol: CTSB
  Gene Name: cathepsin B
  ENSP ID: ENSP00000436456
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWL

SEQ ID NO: 12556 - protein, 148 aa, Homo sapiens
  Payload ID: 2450
  Gene Symbol: CTSB
  Gene Name: cathepsin B
  ENSP ID: ENSP00000436627
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGD

SEQ ID NO: 12557 - protein, 76 aa, Homo sapiens
  Payload ID: 2450
  Gene Symbol: CTSB
  Gene Name: cathepsin B
  ENSP ID: ENSP00000473301
SGVYQHVTGEMMGGHAIRILGWGVENGTPYWLVANSWNTDWGDNGFFKILRGQDHCGIESEVVAGIPRTDQYWEKI

SEQ ID NO: 12558 - protein, 463 aa, Homo sapiens
  Payload ID: 2451
  Gene Symbol: CTSC
  Gene Name: cathepsin C
  Uniprot ID: P53634
  ENSP ID: ENSP00000227266
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 12559 - protein, 137 aa, Homo sapiens
  Payload ID: 2451
  Gene Symbol: CTSC
  Gene Name: cathepsin C
  Uniprot ID: P53634
  ENSP ID: ENSP00000432541
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLVIK

SEQ ID NO: 12560 - protein, 244 aa, Homo sapiens
  Payload ID: 2451
  Gene Symbol: CTSC
  Gene Name: cathepsin C
  ENSP ID: ENSP00000432556
  MOD_RES (1)..(1): Any amino acid
XVVDSPLARSARLPGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQE

SEQ ID NO: 12561 - protein, 36 aa, Homo sapiens
  Payload ID: 2451
  Gene Symbol: CTSC
  Gene Name: cathepsin C
  ENSP ID: ENSP00000433229
  MOD_RES (1)..(1): Any amino acid
XDVTDFISHLFMQLGTVGIYDLPHLRNKLAMNRRWG

SEQ ID NO: 12562 - protein, 141 aa, Homo sapiens
  Payload ID: 2451
  Gene Symbol: CTSC
  Gene Name: cathepsin C
  Uniprot ID: P53634
  ENSP ID: ENSP00000433539
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLAMNRRWG

SEQ ID NO: 12563 - protein, 412 aa, Homo sapiens
  Payload ID: 2452
  Gene Symbol: CTSD
  Gene Name: cathepsin D
  Uniprot ID: P07339
  ENSP ID: ENSP00000236671
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 12564 - protein, 199 aa, Homo sapiens
  Payload ID: 2452
  Gene Symbol: CTSD
  Gene Name: cathepsin D
  ENSP ID: ENSP00000356164
MSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLS

SEQ ID NO: 12565 - protein, 189 aa, Homo sapiens
  Payload ID: 2452
  Gene Symbol: CTSD
  Gene Name: cathepsin D
  ENSP ID: ENSP00000402586
NVTRKAYWQVHLDQSPEGRRVQPSQGRGSQGGALGPQGTLQSRQGLHALTPRRVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 12566 - protein, 276 aa, Homo sapiens
  Payload ID: 2452
  Gene Symbol: CTSD
  Gene Name: cathepsin D
  ENSP ID: ENSP00000404902
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQ

SEQ ID NO: 12567 - protein, 299 aa, Homo sapiens
  Payload ID: 2452
  Gene Symbol: CTSD
  Gene Name: cathepsin D
  ENSP ID: ENSP00000415036
MPRPVVDRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKA

SEQ ID NO: 12568 - protein, 396 aa, Homo sapiens
  Payload ID: 2453
  Gene Symbol: CTSE
  Gene Name: cathepsin E
  Uniprot ID: P14091
  ENSP ID: ENSP00000350911
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 12569 - protein, 363 aa, Homo sapiens
  Payload ID: 2453
  Gene Symbol: CTSE
  Gene Name: cathepsin E
  Uniprot ID: P14091
  ENSP ID: ENSP00000353350
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 12570 - protein, 484 aa, Homo sapiens [sequence omitted]

SEQ ID NO: 12571 - protein, 282 aa, Homo sapiens
  Payload ID: 2454
  Gene Symbol: CTSF
  Gene Name: cathepsin F
  ENSP ID: ENSP00000433082
  MOD_RES (1)..(1): Any amino acid
XQNHPDNRNETFSSVISLLNEDPLSQDLPVKMASIFKNFVITYNRTYESKEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVL

SEQ ID NO: 12572 - protein, 82 aa, Homo sapiens
  Payload ID: 2454
  Gene Symbol: CTSF
  Gene Name: cathepsin F
  ENSP ID: ENSP00000434936
  MOD_RES (1)..(1): Any amino acid
XRTIYLNTLLRKEPGNKMKQAKSVGDLAPPEWDWRSKGAVTKVKDQGMCGSCWAFSVTGNVEGQWFLNQGTLLSLSEQALGL

SEQ ID NO: 12573 - protein, 120 aa, Homo sapiens
  Payload ID: 2454
  Gene Symbol: CTSF
  Gene Name: cathepsin F
  ENSP ID: ENSP00000435822
MVCRLPVSKKTLLCSFQVLDELGRHVLLRKDCGPVDTKVPGAGEPKSAFTQGSAMISSLSQNHPDNRNETFSSVISLLNEDPLSQDLPVKMASIFKNFVITYNRTYESKEEARWRLSVFV

SEQ ID NO: 12574 - protein, 255 aa, Homo sapiens
  Payload ID: 2455
  Gene Symbol: CTSG
  Gene Name: cathepsin G
  Uniprot ID: P08311
  ENSP ID: ENSP00000216336
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 12575 - protein, 335 aa, Homo sapiens
  Payload ID: 2456
  Gene Symbol: CTSH
  Gene Name: cathepsin H
  Uniprot ID: P09668
  ENSP ID: ENSP00000220166
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 12576 - protein, 62 aa, Homo sapiens
  Payload ID: 2456
  Gene Symbol: CTSH
  Gene Name: cathepsin H
  ENSP ID: ENSP00000431879
MWATLPLLCAGAWLLGVPVCGAAELCVNSLEKFHFKSWMSKKTKAHCVLVAESVGEHQCMCF

SEQ ID NO: 12577 - protein, 41 aa, Homo sapiens
  Payload ID: 2456
  Gene Symbol: CTSH
  Gene Name: cathepsin H
  ENSP ID: ENSP00000432893
MWATLPLLCAGAWLLGVPVCGAAELCVNSLGTQRARRPRGC

SEQ ID NO: 12578 - protein, 118 aa, Homo sapiens
  Payload ID: 2456
  Gene Symbol: CTSH
  Gene Name: cathepsin H
  ENSP ID: ENSP00000432935
MWATLPLLCAGAWLLGVPVCGAAELCVNSLVAGLSPPLGPWSLRSPSQPERCCPWRNSSWWTAPRTSIITAAKGVSPARLSSISCTTRGSWVKTPTPTRARMVIASSNLERPSALSRM

SEQ ID NO: 12579 - protein, 134 aa, Homo sapiens
  Payload ID: 2456
  Gene Symbol: CTSH
  Gene Name: cathepsin H
  ENSP ID: ENSP00000435329
MALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGK

SEQ ID NO: 12580 - protein, 323 aa, Homo sapiens
  Payload ID: 2456
  Gene Symbol: CTSH
  Gene Name: cathepsin H
  ENSP ID: ENSP00000483303
MWATLPLLCAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 12581 - protein, 329 aa, Homo sapiens
  Payload ID: 2457
  Gene Symbol: CTSK
  Gene Name: cathepsin K
  Uniprot ID: P43235
  ENSP ID: ENSP00000271651
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 12582 - protein, 258 aa, Homo sapiens
  Payload ID: 2457
  Gene Symbol: CTSK
  Gene Name: cathepsin K
  ENSP ID: ENSP00000405083
MHKENEEIYNVSENRKHCPIFPCPLLTRSGKVPEFRHEREERLEEMIRRQNLDGNLSFVMWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSED

SEQ ID NO: 12583 - protein, 225 aa, Homo sapiens
  Payload ID: 2458
  Gene Symbol: CTSL
  Gene Name: cathepsin L
  ENSP ID: ENSP00000340470
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATVSGAPCHHSSSAFGRWTL

SEQ ID NO: 12584 - protein, 333 aa, Homo sapiens [sequence omitted]

SEQ ID NO: 12585 - protein, 333 aa, Homo sapiens [sequence omitted]

SEQ ID NO: 12586 - protein, 321 aa, Homo sapiens
  Payload ID: 2459
  Gene Symbol: CTSO
  Gene Name: cathepsin O
  Uniprot ID: P43234
  ENSP ID: ENSP00000414904
MDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 12587 - protein, 321 aa, Homo sapiens; identical to SEQ ID NO: 12586
  Payload ID: 2459
  Gene Symbol: CTSO
  Gene Name: cathepsin O
  Uniprot ID: P43234
  ENSP ID: ENSP00000460395

SEQ ID NO: 12588 - protein, 331 aa, Homo sapiens
  Payload ID: 2460
  Gene Symbol: CTSS
  Gene Name: cathepsin S
  Uniprot ID: P25774
  ENSP ID: ENSP00000357981
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 12589 - protein, 281 aa, Homo sapiens
  Payload ID: 2460
  Gene Symbol: CTSS
  Gene Name: cathepsin S
  Uniprot ID: P25774
  ENSP ID: ENSP00000408414
MKRLVCVLLVCSSAVAQLHKDPTLDHHWHLWKKTYGKQYKEKNEEAVRRLIWEKNLKFVMLHNLEHSMGMHSYDLGMNHLGDMGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 12590 - protein, 96 aa, Homo sapiens
  Payload ID: 2460
  Gene Symbol: CTSS
  Gene Name: cathepsin S
  ENSP ID: ENSP00000475176
  MOD_RES (1)..(1): Any amino acid
XVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 12591 - protein, 5 aa, Homo sapiens
  Payload ID: 2460
  Gene Symbol: CTSS
  Gene Name: cathepsin S
  ENSP ID: ENSP00000475557
  MOD_RES (1)..(1): Any amino acid
XYPEI

SEQ ID NO: 12592 - protein, 117 aa, Homo sapiens
  Payload ID: 2460
  Gene Symbol: CTSS
  Gene Name: cathepsin S
  ENSP ID: ENSP00000475812
IIDNKGIDSDASYPYKAMDQKCQYDSKYRAATCSKYTELPYGREDVLKEAVANKGPVSVGVDARHPSFFLYRSDGVLLCCQAGVRWHDLSSLQPLPPGFKQFSCLSLLSSWDYRCLL

SEQ ID NO: 12593 - protein, 334 aa, Homo sapiens
  Payload ID: 2461
  Gene Symbol: CTSV
  Gene Name: cathepsin V
  Uniprot ID: O60911
  ENSP ID: ENSP00000259470
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 12594 - protein, 334 aa, Homo sapiens; identical to SEQ ID NO: 12593
  Payload ID: 2461
  Gene Symbol: CTSV
  Gene Name: cathepsin V
  Uniprot ID: O60911
  ENSP ID: ENSP00000445052

SEQ ID NO: 12595 - protein, 376 aa, Homo sapiens
  Payload ID: 2462
  Gene Symbol: CTSW
  Gene Name: cathepsin W
  Uniprot ID: P56202
  ENSP ID: ENSP00000311300
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 12596 - protein, 211 aa, Homo sapiens
  Payload ID: 2462
  Gene Symbol: CTSW
  Gene Name: cathepsin W
  ENSP ID: ENSP00000434267
ALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQGGLASEKDYPFQGKVRAHRCHPKKYQKVAWIQD

SEQ ID NO: 12597 - protein, 364 aa, Homo sapiens
  Payload ID: 2462
  Gene Symbol: CTSW
  Gene Name: cathepsin W
  ENSP ID: ENSP00000436568
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKVSVIYWGRGQGRTGLFPPSRPYVP

SEQ ID NO: 12598 - protein, 303 aa, Homo sapiens
  Payload ID: 2463
  Gene Symbol: CTSZ
  Gene Name: cathepsin Z
  Uniprot ID: Q9UBR2
  ENSP ID: ENSP00000217131
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 12599 - protein, 780 aa, Homo sapiens
  Payload ID: 2464
  Gene Symbol: CATSPER1
  Gene Name: cation channel, sperm associated 1
  Uniprot ID: Q8NEC5
  ENSP ID: ENSP00000309052
MDQNSVPEKAQNEADTNNADRFFRSHSSPPHHRPGHSRALHHYELHHHGVPHQRGESHHPPEFQDFHDQALSSHVHQSHHHSEARNHGRAHGPTGFGLAPSQGAVPSHRSYGEDYHDELQRDGRRHHDGSQYGGFHQQSDSHYHRGSHHGRPQYLGENLSHYSSGVPHHGEASHHGGSYLPHGPNPYSESFHHSEASHLSGLQHDESQHHQVPHRGWPHHHQVHHHGRSRHHEAHQHGKSPHHGETISPHSSVGSYQRGISDYHSEYHQGDHHPSEYHHGDHPHHTQHHYHQTHRHRDYHQHQDHHGAYHSSYLHGDYVQSTSQLSIPHTSRSLIHDAPGPAASRTGVFPYHVAHPRGSAHSMTRSSSTIRSRVTQMSKKVHTQDISTKHSEDWGKEEGQFQKRKTGRLQRTRKKGHSTNLFQWLWEKLTFLIQGFREMIRNLTQSLAFETFIFFVVCLNTVMLVAQTFAEVEIRGEWYFMALDSIFFCIYVVEALLKIIALGLSYFFDFWNNLDFFIMAMAVLDFLLMQTHSFAIYHQSLFRILKVFKSLRALRAIRVLRRLSFLTSVQEVTGTLGQSLPSIAAILILMFTCLFLFSAVLRALFRKSDPKRFQNIFTTIFTLFTLLTLDDWSLIYMDSRAQGAWYIIPILVIYIIIQYFIFLNLVITVLVDSFQTALFKGLEKAKQERAARIQEKLLEDSLTELRAAEPKEVASEGTMLKRLIEKKFGTMTEKQQELLFHYLQLVASVEQEQQKFRSQAAVIDEIVDTTFEAGEEDFRN

SEQ ID NO: 12600 - protein, 530 aa, Homo sapiens
  Payload ID: 2465
  Gene Symbol: CATSPER2
  Gene Name: cation channel, sperm associated 2
  Uniprot ID: Q96P56
  ENSP ID: ENSP00000321463
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDSSRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 12601 - protein, 534 aa, Homo sapiens
  Payload ID: 2465
  Gene Symbol: CATSPER2
  Gene Name: cation channel, sperm associated 2
  ENSP ID: ENSP00000371180
MVLGSDMAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 12602 - protein, 528 aa, Homo sapiens
  Payload ID: 2465
  Gene Symbol: CATSPER2
  Gene Name: cation channel, sperm associated 2
  Uniprot ID: Q96P56
  ENSP ID: ENSP00000380088
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 12603 - protein, 64 aa, Homo sapiens
  Payload ID: 2465
  Gene Symbol: CATSPER2
  Gene Name: cation channel, sperm associated 2
  ENSP ID: ENSP00000386595
MAAYQQEEQMQLPRADAIRSRLIDTFSLIEHLQGLSQAVPRHTIRELLDPSRQKKLVLGDQHQL

SEQ ID NO: 12604 - protein, 74 aa, Homo sapiens
  Payload ID: 2465
  Gene Symbol: CATSPER2
  Gene Name: cation channel, sperm associated 2
  ENSP ID: ENSP00000388242
  MOD_RES (1)..(1): Any amino acid
XRFSESIGRLDWETLVHENLPGLMEMDQDDRVWPRDSLFRYFELLEKLQYNLEERKKLQEFAGKKKAGHGGSHL

SEQ ID NO: 12605 - protein, 414 aa, Homo sapiens
  Payload ID: 2465
  Gene Symbol: CATSPER2
  Gene Name: cation channel, sperm associated 2
  Uniprot ID: Q96P56
  ENSP ID: ENSP00000389746
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRSFGLGDSCARKSARANGNGSG

SEQ ID NO: 12606 - protein, 79 aa, Homo sapiens
  Payload ID: 2465
  Gene Symbol: CATSPER2
  Gene Name: cation channel, sperm associated 2
  ENSP ID: ENSP00000407694
MAAYQQEEQMQLPRADAIRSRLIDTFSLIEHLQGLSQAVPRHTIRELLDPSRQKKLVLGDQHQLVRFSIKPQRIEQISH

SEQ ID NO: 12607 - protein, 13 aa, Homo sapiens
  Payload ID: 2465
  Gene Symbol: CATSPER2
  Gene Name: cation channel, sperm associated 2
  ENSP ID: ENSP00000408240
  MOD_RES (1)..(1): Any amino acid
XLTSSHSKIEDRS

SEQ ID NO: 12608 - protein, 398 aa, Homo sapiens
  Payload ID: 2466
  Gene Symbol: CATSPER3
  Gene Name: cation channel, sperm associated 3
  Uniprot ID: Q86XQ3
  ENSP ID: ENSP00000282611
MSQHRHQRHSRVISSSPVDTTSVGFCPTFKKFKRNDDECRAFVKRVIMSRFFKIIMISTVTSNAFFMALWTSYDIRYRLFRLLEFSEIFFVSICTSELSMKVYVDPINYWKNGYNLLDVIIIIVMFLPYALRQLMGKQFTYLYIADGMQSLRILKLIGYSQGIRTLITAVGQTVYTVASVLLLLFLLMYIFAILGFCLFGSPDNGDHDNWGNLAAAFFTLFSLATVDGWTDLQKQLDNREFALSRAFTIIFILLASFIFLNMFVGVMIMHTEDSIRKFERELMLEQQEMLMGEKQVILQRQQEEISRLMHIQKNADCTSFSELVENFKKTLSHTDPMVLDDFGTSLPFIDIYFSTLDYQDTTVHKLQELYYEIVHVLSLMLEDLPQEKPQSLEKVDEK

SEQ ID NO: 12609 - protein, 483 aa, Homo sapiens
  Payload ID: 2467
  Gene Symbol: CATSPER4
  Gene Name: cation channel, sperm associated 4
  ENSP ID: ENSP00000341006
MRDNEKAWWQQWTSHTGLEGWGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLVFSVFGVTLFGAFVPKHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNMIVEEVRAIRFNQEQESEVLNRRSSTSGSLETTSSKDIRQMSQQQDLLSALVSMEKVCLPSPTQWVLALTLCSAQPSRASGPFV

SEQ ID NO: 12610 - protein, 472 aa, Homo sapiens
  Payload ID: 2467
  Gene Symbol: CATSPER4
  Gene Name: cation channel, sperm associated 4
  Uniprot ID: Q7RTX7
  ENSP ID: ENSP00000390423
MRDNEKAWWQQWTSHTGLEGWGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLVFSVFGVTLFGAFVPKHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNMIVEEVRAIRFNQEQESEVLNRRSSTSGSLETTSSKDIRQMSQQQDLLSALVSMEKVHDSSSQILLKKHKSSH

SEQ ID NO: 12611 - protein, 384 aa, Homo sapiens
  Payload ID: 2467
  Gene Symbol: CATSPER4
  Gene Name: cation channel, sperm associated 4
  Uniprot ID: Q7RTX7
  ENSP ID: ENSP00000429464
MRDNEKAWWQQWTSHTGLEGWGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNM

SEQ ID NO: 12612 - protein, 373 aa, Homo sapiens
  Payload ID: 2467
  Gene Symbol: CATSPER4
  Gene Name: cation channel, sperm associated 4
  ENSP ID: ENSP00000477936
MDLPYRPRGVGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNM

SEQ ID NO: 12613 - protein, 1116 aa, Homo sapiens
  Payload ID: 2468
  Gene Symbol: CATSPERB
  Gene Name: catsper channel auxiliary subunit beta
  Uniprot ID: Q9H7T0
  ENSP ID: ENSP00000256343
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFNLTLFSDRILWLVDIPRENITQSTDIAAVEEWLVRITLHHGLNIYATEGTLLDVIREPILQWTPGDVIPESEISKLYPHVVDLKVTKCPCANDVALLGFIVDTIVDGVYIGITFGGFWHDYDTTWFNMTQTIYSQLQEEYEDLSLVDMVLTNHFLVILTSLGLFVSEDLRYPSRHSLSFSRADFCGFERVDYVKGKLWYNERCFANREHFEVDYVTVTFERNRTLSESSSCFYSQEPFLEWVPCLPHIFKGIKIFPTVLTFLVDQERGTGVYLFYNKVRKTAIASVSTLRNNEPNSQSKFPIFRFPSSFSSPVGMVFHPRSHFLYAYGNQIWLSVDGGNTFQLIANFHDDIIKKTFHSFYTSAITFVSQRGKVYSTKAGMGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSGKTGRAYIRKVLQHTTPKGFLSSVIAEMKEPFGLEEVNESSCLSSSLLINKAGNVYKLTLDSQVVQALFEDTDIEKTVVLPGYSSFLITSILDNKNALAIATMPESAPNNMTFLKSTWFLYNFGQRNGRTWKIYSKPCNYWFQHDDSPSLNIVKYIDLGNSYVLKAKVIRNAKGFRMLEIPLLTVFVGNPNLLEVTAEVTFDDTDSYVITISAASKVLHQGSTSLAFIMWSASTECFVTTMVPTLKSSCSYLRSMHHIPSKFIPFEDWISGVHKDSQGFNLIKTLPINYRPPSNMGIAIPLTDNFYHADPSKPIPRNMFHMSKKTGKFKQCANVSTREECNCTKDQKFSHAVAFSDCREKVPRFKFPITQYPVSLEIINEDGRVPLQSPYLVTVTEVNMRHNWKLKHTVPENIKRMKQLVEPILGAAVYNPSGLNLSIKGSELFHFRVTVISGVTFCNLIEEFQIYVDEAPLPFPGHTLIAVATAVVLGGLIFIAFMFQLQGIHPWRTFQRWIRRNQEKFSSISLSELIHRSKSEE

SEQ ID NO: 12614 - protein, 150 aa, Homo sapiens
  Payload ID: 2468
  Gene Symbol: CATSPERB
  Gene Name: catsper channel auxiliary subunit beta
  ENSP ID: ENSP00000450878
MESPLIYVSVLLLNIFEFSSGIVYNKDDTEKRFACSNKGFPQENEIIKLYLFLENLFSDRILWLVDIPRENITQSTDIAAVEEWLVRITLHHGLNIYATEGTLLDVIREPILQWTPGDVIPESEISKLYPHVVDLKVTKCPCANDVALLG

SEQ ID NO: 12615 - protein, 73 aa, Homo sapiens
  Payload ID: 2468
  Gene Symbol: CATSPERB
  Gene Name: catsper channel auxiliary subunit beta
  ENSP ID: ENSP00000451047
MESPLIYVSVLLLNIFEFSSGIVYNKDDTEKRFACSNKGFPQENEIIKLYLFLENLKIQCFFQTENEIASKAM

SEQ ID NO: 12616 - protein, 67 aa, Homo sapiens
  Payload ID: 2468
  Gene Symbol: CATSPERB
  Gene Name: catsper channel auxiliary subunit beta
  ENSP ID: ENSP00000451083
NEPNSQSKFPIFRFPSSFSSPVGMVFHPRSHFLYAYGNQEWEDTVQSEVLLREFSHYTMITWDSYIS

SEQ ID NO: 12617 - protein, 74 aa, Homo sapiens
  Payload ID: 2468
  Gene Symbol: CATSPERB
  Gene Name: catsper channel auxiliary subunit beta
  ENSP ID: ENSP00000451455
MESPLIYVSVLLLNIFEFSSGIVYNKDDTEKRFACSNKGFPQENEIIKLYLFLENLKIQCFFQTENEIASKAML

SEQ ID NO: 12618 - protein, 100 aa, Homo sapiens
  Payload ID: 2468
  Gene Symbol: CATSPERB
  Gene Name: catsper channel auxiliary subunit beta
  ENSP ID: ENSP00000452224
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFN

SEQ ID NO: 12619 - protein, 1116 aa, Homo sapiens; identical to SEQ ID NO: 12613
  Payload ID: 2468
  Gene Symbol: CATSPERB
  Gene Name: catsper channel auxiliary subunit beta
  Uniprot ID: Q9H7T0
  ENSP ID: ENSP00000478546

SEQ ID NO: 12620 - protein, 73 aa, Homo sapiens; identical to SEQ ID NO: 12615
  Payload ID: 2468
  Gene Symbol: CATSPERB
  Gene Name: catsper channel auxiliary subunit beta
  ENSP ID: ENSP00000488258

SEQ ID NO: 12621 - protein, 67 aa, Homo sapiens; identical to SEQ ID NO: 12616
  Payload ID: 2468
  Gene Symbol: CATSPERB
  Gene Name: catsper channel auxiliary subunit beta
  ENSP ID: ENSP00000488380

SEQ ID NO: 12622 - protein, 150 aa, Homo sapiens; identical to SEQ ID NO: 12614
  Payload ID: 2468
  Gene Symbol: CATSPERB
  Gene Name: catsper channel auxiliary subunit beta
  ENSP ID: ENSP00000488739

SEQ ID NO: 12623 - protein, 74 aa, Homo sapiens; identical to SEQ ID NO: 12617
  Payload ID: 2468
  Gene Symbol: CATSPERB
  Gene Name: catsper channel auxiliary subunit beta
  ENSP ID: ENSP00000488745

SEQ ID NO: 12624 - protein, 100 aa, Homo sapiens; identical to SEQ ID NO: 12618
  Payload ID: 2468
  Gene Symbol: CATSPERB
  Gene Name: catsper channel auxiliary subunit beta
  ENSP ID: ENSP00000488766

SEQ ID NO: 12625 - protein, 798 aa, Homo sapiens
  Payload ID: 2469
  Gene Symbol: CATSPERD
  Gene Name: catsper channel auxiliary subunit delta
  Uniprot ID: Q86XM0
  ENSP ID: ENSP00000371037
MLMLMLVAAVTMWLRPLVTAQLCRSRTVRTGKVFNLIQDVQGDRLYFHPTTTRLIKHPCEKNIALYLGKQVFFTMDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNQGKGMFKYSDHPLNRSFGLSFDYNGTLDILIAPGQRGILLLWFENSLLFSHNAGQLVDTVRVKKGDQTLFSSIFEAKITIHNIAVTENELAVITREDNLYYGNLGIVPSSIIKFADQYIWSEDVALMFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQLVSAGVVILLIISSILGSVWLAYKTPKLLRTARGRRIKKCATQLCRRCKTVCQFRASATARAGTEPPGRHRTPHGGRSDH

SEQ ID NO: 12626 - protein, 292 aa, Homo sapiens
  Payload ID: 2470
  Gene Symbol: CATSPERG
  Gene Name: catsper channel auxiliary subunit gamma
  ENSP ID: ENSP00000311314
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVEAPIPHSMRETAAVAVGFVSWPASASRSCALCISIAMALST

SEQ ID NO: 12627 - protein, 660 aa, Homo sapiens
  Payload ID: 2470
  Gene Symbol: CATSPERG
  Gene Name: catsper channel auxiliary subunit gamma
  ENSP ID: ENSP00000386950
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERY

SEQ ID NO: 12628 - protein, 1159 aa, Homo sapiens
  Payload ID: 2470
  Gene Symbol: CATSPERG
  Gene Name: catsper channel auxiliary subunit gamma
  Uniprot ID: Q6ZRH7
  ENSP ID: ENSP00000386962
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 12629 - protein, 1119 aa, Homo sapiens
  Payload ID: 2470
  Gene Symbol: CATSPERG
  Gene Name: catsper channel auxiliary subunit gamma
  ENSP ID: ENSP00000387057
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 12630 - protein, 165 aa, Homo sapiens
  Payload ID: 2470
  Gene Symbol: CATSPERG
  Gene Name: catsper channel auxiliary subunit gamma
  ENSP ID: ENSP00000395093
RWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVEAVGFVSWPASASRSCALCISIAMALST

SEQ ID NO: 12631 - protein, 136 aa, Homo sapiens
  Payload ID: 2470
  Gene Symbol: CATSPERG
  Gene Name: catsper channel auxiliary subunit gamma
  ENSP ID: ENSP00000467947
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKGSR

SEQ ID NO: 12632 - protein, 159 aa, Homo sapiens
  Payload ID: 2470
  Gene Symbol: CATSPERG
  Gene Name: catsper channel auxiliary subunit gamma
  ENSP ID: ENSP00000468028
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKTESCAVAQTGVQWRDLGSLQPPPPVFKRCSCLGLPSSWNYSPLRTWCAWAT

SEQ ID NO: 12633 - protein, 180 aa, Homo sapiens
  Payload ID: 2470
  Gene Symbol: CATSPERG
  Gene Name: catsper channel auxiliary subunit gamma
  ENSP ID: ENSP00000470225
  MOD_RES (1)..(1): Any amino acid
XRNRGSGSWIRVLASECIKKLCPVYFHSNGSEYIMALTTGKHEGYVHFGTIRASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQ

SEQ ID NO: 12634 - protein, 265 aa, Homo sapiens
  Payload ID: 2471
  Gene Symbol: CDX1
  Gene Name: caudal type homeobox 1
  Uniprot ID: P47902
  ENSP ID: ENSP00000231656
MYVGYVLDKDSPVYPGPARPASLGLGPQAYGPPAPPPAPPQYPDFSSYSHVEPAPAPPTAWGAPFPAPKDDWAAAYGPGPAAPAASPASLAFGPPPDFSPVPAPPGPGPGLLAQPLGGPGTPSSPGAQRPTPYEWMRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 12635 - protein, 154 aa, Homo sapiens [sequence omitted]

SEQ ID NO: 12636 - protein, 313 aa, Homo sapiens
  Payload ID: 2472
  Gene Symbol: CDX2
  Gene Name: caudal type homeobox 2
  Uniprot ID: Q99626
  ENSP ID: ENSP00000370408
MYVSYLLDKDVSMYPSSVRHSGGLNLAPQNFVSPPQYPDYGGYHVAAAAAAAANLDSAQSPGPSWPAAYGAPLREDWNGYAPGGAAAAANAVAHGLNGGSPAAAMGYSSPADYHPHHHPHHHPHHPAAAPSCASGLLQTLNPGPPGPAATAAAEQLSPGGQRRNLCEWMRKPAQQSLGSQVKTRTKDKYRVVYTDHQRLELEKEFHYSRYITIRRKAELAATLGLSERQVKIWFQNRRAKERKINKKKLQQQQQQQPPQPPPPPPQPPQPQPGPLRSVPEPLSPVSSLQASVPGSVPGVLGPTGGVLNPTVTQ

SEQ ID NO: 12637 - protein, 284 aa, Homo sapiens
  Payload ID: 2473
  Gene Symbol: CDX4
  Gene Name: caudal type homeobox 4
  Uniprot ID: O14627
  ENSP ID: ENSP00000362613
MYGSCLLEKEAGMYPGTLMSPGGDGTAGTGGTGGGGSPMPASNFAAAPAFSHYMGYPHMPSMDPHWPSLGVWGSPYSPPREDWSVYPGPSSTMGTVPVNDVTSSPAAFCSTDYSNLGPVGGGTSGSSLPGQAGGSLVPTDAGAAKASSPSRSRHSPYAWMRKTVQVTGKTRTKEKYRVVYTDHQRLELEKEFHCNRYITIQRKSELAVNLGLSERQVKIWFQNRRAKERKMIKKKISQFENSGGSVQSDSDSISPGELPNTFFTTPSAVRGFQPIEIQQVIVSE

SEQ ID NO: 12638 - protein, 178 aa, Homo sapiens
  Payload ID: 2474
  Gene Symbol: CAV1
  Gene Name: caveolin 1, caveolae protein, 22kDa
  Uniprot ID: Q03135
  ENSP ID: ENSP00000339191
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 12639 - protein, 147 aa, Homo sapiens
  Payload ID: 2474
  Gene Symbol: CAV1
  Gene Name: caveolin 1, caveolae protein, 22kDa
  Uniprot ID: Q03135
  ENSP ID: ENSP00000377110
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 12640 - protein, 147 aa, Homo sapiens; identical to SEQ ID NO: 12639
  Payload ID: 2474
  Gene Symbol: CAV1
  Gene Name: caveolin 1, caveolae protein, 22kDa
  Uniprot ID: Q03135
  ENSP ID: ENSP00000377111

SEQ ID NO: 12641 - protein, 167 aa, Homo sapiens
  Payload ID: 2474
  Gene Symbol: CAV1
  Gene Name: caveolin 1, caveolae protein, 22kDa
  ENSP ID: ENSP00000377113
MSGGKYVDSEGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 12642 - protein, 147 aa, Homo sapiens; identical to SEQ ID NO: 12639
  Payload ID: 2474
  Gene Symbol: CAV1
  Gene Name: caveolin 1, caveolae protein, 22kDa
  Uniprot ID: Q03135
  ENSP ID: ENSP00000384348

SEQ ID NO: 12643 - protein, 138 aa, Homo sapiens
  Payload ID: 2474
  Gene Symbol: CAV1
  Gene Name: caveolin 1, caveolae protein, 22kDa
  ENSP ID: ENSP00000389033
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSN

SEQ ID NO: 12644 - protein, 86 aa, Homo sapiens
  Payload ID: 2474
  Gene Symbol: CAV1
  Gene Name: caveolin 1, caveolae protein, 22kDa
  ENSP ID: ENSP00000409541
MSGGKYVDSEVGIRGGAPARACGECPLLLSASPNIPTAALAPALSPLRSTPLALAPLRNGPGRGGEEKPGMFYVFLMERGPREPLS

SEQ ID NO: 12645 - protein, 147 aa, Homo sapiens; identical to SEQ ID NO: 12639
  Payload ID: 2474
  Gene Symbol: CAV1
  Gene Name: caveolin 1, caveolae protein, 22kDa
  Uniprot ID: Q03135
  ENSP ID: ENSP00000479447

SEQ ID NO: 12646 - protein, 162 aa, Homo sapiens
  Payload ID: 2475
  Gene Symbol: CAV2
  Gene Name: caveolin 2
  Uniprot ID: P51636
  ENSP ID: ENSP00000222693
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 12647 - protein, 112 aa, Homo sapiens
  Payload ID: 2475
  Gene Symbol: CAV2
  Gene Name: caveolin 2
  Uniprot ID: P51636
  ENSP ID: ENSP00000345679
MGLETEKADVQLFMDDDSYSHHSGLEYADPEKFADSDQDRDPHRLNSHLKDFNAFCKDLPNGSAFSADNMEECDRCYHCSIVYERRTMLLFCQPATEPGLNTWTPGLEIGIL

SEQ ID NO: 12648 - protein, 113 aa, Homo sapiens
  Payload ID: 2475
  Gene Symbol: CAV2
  Gene Name: caveolin 2
  ENSP ID: ENSP00000377120
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIW

SEQ ID NO: 12649 - protein, 151 aa, Homo sapiens
  Payload ID: 2476
  Gene Symbol: CAV3
  Gene Name: caveolin 3
  Uniprot ID: P56539
  ENSP ID: ENSP00000341940
MMAEEHTDLEAQIVKDIHCKEIDLVNRDPKNINEDIVKVDFEDVIAEPVGTYSFDGVWKVSYTTFTVSKYWCYRLLSTLLGVPLALLWGFLFACISFCHIWAVVPCIKSYLIEIQCISHIYSLCIRTFCNPLFAALGQVCSSIKVVLRKEV

SEQ ID NO: 12650 - protein, 151 aa, Homo sapiens; identical to SEQ ID NO: 12649
  Payload ID: 2476
  Gene Symbol: CAV3
  Gene Name: caveolin 3
  Uniprot ID: P56539
  ENSP ID: ENSP00000380525

SEQ ID NO: 12651 - protein, 982 aa, Homo sapiens [sequence omitted]

SEQ ID NO: 12652 - protein, 321 aa, Homo sapiens
  Payload ID: 2477
  Gene Symbol: CBLB
  Gene Name: Cbl proto-oncogene B, E3 ubiquitin protein ligase
  ENSP ID: ENSP00000377598
GITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 12653 - protein, 197 aa, Homo sapiens
  Payload ID: 2477
  Gene Symbol: CBLB
  Gene Name: Cbl proto-oncogene B, E3 ubiquitin protein ligase
  ENSP ID: ENSP00000384170
MLNGTHGPSSEKKSNIPDLSIYLKGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 12654 - protein, 770 aa, Homo sapiens
  Payload ID: 2477
  Gene Symbol: CBLB
  Gene Name: Cbl proto-oncogene B, E3 ubiquitin protein ligase
  Uniprot ID: Q13191
  ENSP ID: ENSP00000384816
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGTYRI

SEQ ID NO: 12655 - protein, 810 aa, Homo sapiens
  Payload ID: 2477
  Gene Symbol: CBLB
  Gene Name: Cbl proto-oncogene B, E3 ubiquitin protein ligase
  ENSP ID: ENSP00000384938
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGDVFDSASDPVPLPPARPPTRDNPKHGSSLNRTPSDYDLLIPPLG

SEQ ID NO: 12656 - protein, 139 aa, Homo sapiens
  Payload ID: 2477
  Gene Symbol: CBLB
  Gene Name: Cbl proto-oncogene B, E3 ubiquitin protein ligase
  ENSP ID: ENSP00000393906
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQD

SEQ ID NO: 12657 - protein, 139 aa, Homo sapiens; identical to SEQ ID NO: 12656
  Payload ID: 2477
  Gene Symbol: CBLB
  Gene Name: Cbl proto-oncogene B, E3 ubiquitin protein ligase
  ENSP ID: ENSP00000400949

SEQ ID NO: 12658 - protein, 161 aa, Homo sapiens
  Payload ID: 2477
  Gene Symbol: CBLB
  Gene Name: Cbl proto-oncogene B, E3 ubiquitin protein ligase
  ENSP ID: ENSP00000409750
MALAPGPDAHAHLPPLIELKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQD

SEQ ID NO: 12659 - protein, 474 aa, Homo sapiens
  Payload ID: 2478
  Gene Symbol: CBLC
  Gene Name: Cbl proto-oncogene C, E3 ubiquitin protein ligase
  Uniprot ID: Q9ULV8
  ENSP ID: ENSP00000270279
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYIFRPSCTRLGQWAIGYVSSDGSILQTIPANKPLSQVLLEGQKDGFYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 12660 - protein, 428 aa, Homo sapiens
  Payload ID: 2478
  Gene Symbol: CBLC
  Gene Name: Cbl proto-oncogene C, E3 ubiquitin protein ligase
  Uniprot ID: Q9ULV8
  ENSP ID: ENSP00000340250
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 12661 - protein, 906 aa, Homo sapiens
  Payload ID: 2479
  Gene Symbol: CBL
  Gene Name: Cbl proto-oncogene, E3 ubiquitin protein ligase
  Uniprot ID: P22681
  ENSP ID: ENSP00000264033
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 12662 - protein, 882 aa, Homo sapiens
  Payload ID: 2479
  Gene Symbol: CBL
  Gene Name: Cbl proto-oncogene, E3 ubiquitin protein ligase
  ENSP ID: ENSP00000489218
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSKQSPKANLRSPDLAAEEISRVLIA

SEQ ID NO: 12663 - protein, 862 aa, Homo sapiens
  Payload ID: 2479
  Gene Symbol: CBL
  Gene Name: Cbl proto-oncogene, E3 ubiquitin protein ligase
  ENSP ID: ENSP00000489324
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 12664 - protein, 89 aa, Homo sapiens
  Payload ID: 2479
  Gene Symbol: CBL
  Gene Name: Cbl proto-oncogene, E3 ubiquitin protein ligase
  ENSP ID: ENSP00000489556
AAAHANTGPEESENEDDGYDVPKPPVPAVLARRTLSDISNASSSFGWLSLDGDPTTNVTEGSQVPERPPKPFPRRINSERKAGSCQQVS

SEQ ID NO: 12665 - protein, 490 aa, Homo sapiens
  Payload ID: 2480
  Gene Symbol: CBLL1
  Gene Name: Cbl proto-oncogene-like 1, E3 ubiquitin protein ligase
  Uniprot ID: Q75N03
  ENSP ID: ENSP00000222597
MDHTDNELQGTNSSGSLGGLDVRRRIPIKLISKQANKAKPAPRTQRTINRMPAKAPPGDEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 12666 - protein, 123 aa, Homo sapiens
  Payload ID: 2480
  Gene Symbol: CBLL1
  Gene Name: Cbl proto-oncogene-like 1, E3 ubiquitin protein ligase
  ENSP ID: ENSP00000401175
MDHTDNELQGTNSSGSLGGLDVRRRIPIKLISKQANKAKPAPRTQRTINRMPAKAPPGDEEGFDYNEEERYDCKGGELFANQRRFPGHLFWDFQINILGEKDDTPVHFCDKCGLPIKIYGRML

SEQ ID NO: 12667 - protein, 491 aa, Homo sapiens
  Payload ID: 2480
  Gene Symbol: CBLL1
  Gene Name: Cbl proto-oncogene-like 1, E3 ubiquitin protein ligase
  Uniprot ID: Q75N03
  ENSP ID: ENSP00000401277
MDHTDNELQGTNSSGSLGGLDVRRRIPIKLISKQANKAKPAPRTQRTINRMPAKAPPGDEEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTLSPPFTQPGGMSPGIWPAPRGPPPPPRLQGPPSQTPLPGPHHPDQTRYRPYYQ

SEQ ID NO: 12668 - protein, 67 aa, Homo sapiens
  Payload ID: 2480
  Gene Symbol: CBLL1
  Gene Name: Cbl proto-oncogene-like 1, E3 ubiquitin protein ligase
  ENSP ID: ENSP00000401374
MDHTDNELQGTNSSGSLGGLDVRRRIPIKLISKQANKAKPAPRTQRTINRMPAKAPPGDEVLGPKES

SEQ ID NO: 12669 - protein, 322 aa, Homo sapiens
  Payload ID: 2480
  Gene Symbol: CBLL1
  Gene Name: Cbl proto-oncogene-like 1, E3 ubiquitin protein ligase
  ENSP ID: ENSP00000410615
MPAKAPPGDEEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQA

SEQ ID NO: 12670 - protein, 193 aa, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENSP ID: ENSP00000246139
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 12671 - protein, 193 aa, Homo sapiens; identical to SEQ ID NO: 12670
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENSP ID: ENSP00000362721

SEQ ID NO: 12672 - protein, 219 aa, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENSP ID: ENSP00000388548
MEPSAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 12673 - protein, 138 aa, Homo sapiens
  Payload ID: 2481
  Gene Symbol: CITED1
  Gene Name: Cbp/p300-interacting transactivator, with Glu/Asp-rich carboxy-terminal domain, 1
  ENSP ID: ENSP00000391407
MEPSAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATP

SEQ ID NO: 12674 - protein, 219 aa, Homo sapiens; identical to SEQ ID NO: 12672
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENSP ID: ENSP00000401764

SEQ ID NO: 12675 - protein, 193 aa, Homo sapiens; identical to SEQ ID NO: 12670
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENSP ID: ENSP00000403274

SEQ ID NO: 12676 - protein, 109 aa, Homo sapiens
  Payload ID: 2481
  Gene Symbol: CITED1
  Gene Name: Cbp/p300-interacting transactivator, with Glu/Asp-rich carboxy-terminal domain, 1
  ENSP ID: ENSP00000405765
MEPSAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSF

SEQ ID NO: 12677 - protein, 106 aa, Homo sapiens
  Payload ID: 2481
  Gene Symbol: CITED1
  Gene Name: Cbp/p300-interacting transactivator, with Glu/Asp-rich carboxy-terminal domain, 1
  ENSP ID: ENSP00000407496
  MOD_RES (1)..(1): Any amino acid
XPTTSRPALDVKGGTSPAKEDANQEMSSVAYSNLAVKDRKAVAILHYPGVASNGTKSPAIIDSDPVDEEVLMSLVVELGLDRANELPELWLGQNEFDFTADFPSSC

SEQ ID NO: 12678 - protein, 59 aa, Homo sapiens
  Payload ID: 2481
  Gene Symbol: CITED1
  Gene Name: Cbp/p300-interacting transactivator, with Glu/Asp-rich carboxy-terminal domain, 1
  ENSP ID: ENSP00000412769
MEPSAQQLQLAASLPANLSNFCQGSEMPTTSRPALDVKGGTSPAKEDANQEMSSVAYSN

SEQ ID NO: 12679 - protein, 140 aa, Homo sapiens
  Payload ID: 2481
  Gene Symbol: CITED1
  Gene Name: Cbp/p300-interacting transactivator, with Glu/Asp-rich carboxy-terminal domain, 1
  ENSP ID: ENSP00000414781
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSA

SEQ ID NO: 12680 - protein, 270 aa, Homo sapiens
  Payload ID: 2482
  Gene Symbol: CITED2
  Gene Name: Cbp/p300-interacting transactivator, with Glu/Asp-rich carboxy-terminal domain, 2
  Uniprot ID: Q99967
  ENSP ID: ENSP00000356623
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 12681 - protein, 270 aa, Homo sapiens; identical to SEQ ID NO: 12680
  Payload ID: 2482
  Gene Symbol: CITED2
  Gene Name: Cbp/p300-interacting transactivator, with Glu/Asp-rich carboxy-terminal domain, 2
  Uniprot ID: Q99967
  ENSP ID: ENSP00000442831

SEQ ID NO: 12682 - protein, 275 aa, Homo sapiens
  Payload ID: 2482
  Gene Symbol: CITED2
  Gene Name: Cbp/p300-interacting transactivator, with Glu/Asp-rich carboxy-terminal domain, 2
  ENSP ID: ENSP00000444198
MSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 12683 - protein, 213 aa, Homo sapiens
  Payload ID: 2482
  Gene Symbol: CITED2
  Gene Name: Cbp/p300-interacting transactivator, with Glu/Asp-rich carboxy-terminal domain, 2
  Uniprot ID: Q99967
  ENSP ID: ENSP00000479918
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPNVIDTDFIDEEVLMSLVIEMGLDRIKELPELWLGQNEFDFMTDFVCKQQPSRVSC

SEQ ID NO: 12684 - protein, 184 aa, Homo sapiens
  Payload ID: 2483
  Gene Symbol: CITED4
  Gene Name: Cbp/p300-interacting transactivator, with Glu/Asp-rich carboxy-terminal domain, 4
  Uniprot ID: Q96RK1
  ENSP ID: ENSP00000361721
MADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 12685 - protein, 598 aa, Homo sapiens
  Payload ID: 2484
  Gene Symbol: CTIF
  Gene Name: CBP80/20-dependent translation initiation factor
  Uniprot ID: O43310
  ENSP ID: ENSP00000256413
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNPLTPPITQYYNRTIQKLTA

SEQ ID NO: 12686 - protein, 600 aa, Homo sapiens
  Payload ID: 2484
  Gene Symbol: CTIF
  Gene Name: CBP80/20-dependent translation initiation factor
  Uniprot ID: O43310
  ENSP ID: ENSP00000372459
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDRRRQQRPPGGNKPQQHGDHQPGSAKHNRDHQKSYQGGSAPHPSGRPTHHGYSQNRRWHHGNMKHPPGDKGEAGAHRNAKETMTIENPKLEDTAGDTGHSSLEAPRSPDTLAPVASERLPPQQSGGPEVETKRKDSILPERIGERPKITLLQSSKDRLRRRLKEKVPDEVAVETTTPQQNKMDKLIEILNSMRNNSSDVDTKLTTFMEEAQNSTNSEEMLGEIVRTIYQKAVSDRSFAFTAAKLCDKMALFMVEGTKFRSLLLNMLQKDFTVREELQQQDVERWLGFITFLCEVFGTMRSSTGEPFRVLVCPIYTCLRELLQSQDVKEDAVLCCSMELQSTGRLLEEQLPEMMTELLASARDKMLCPSESMLTRSLLLEVIELHANSWNPLTPPITQYYNRTIQKLTA

SEQ ID NO: 12687 - protein, 194 aa, Homo sapiens
  Payload ID: 2484
  Gene Symbol: CTIF
  Gene Name: CBP80/20-dependent translation initiation factor
  ENSP ID: ENSP00000465405
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLPHIDREGCGKGKLEDGDGINLNDIEKVLPAWQGYHPMPHEVEIAHTKKLFRRRRNDR

SEQ ID NO: 12688 - protein, 138 aa, Homo sapiens
  Payload ID: 2484
  Gene Symbol: CTIF
  Gene Name: CBP80/20-dependent translation initiation factor
  ENSP ID: ENSP00000467425
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANTFDSFSGATWDLQPEKLDFTQFHRKVRHTPKQPLP

SEQ ID NO: 12689 - protein, 104 aa, Homo sapiens
  Payload ID: 2484
  Gene Symbol: CTIF
  Gene Name: CBP80/20-dependent translation initiation factor
  ENSP ID: ENSP00000467957
MENSSAASASSEAGSSRSQEIEELERFIDSYVLEYQVQGLLADKTEGDGESERTQSHISQWTADCSEPLDSSCSFSRGRAPPQQNGSKDNSLDMLGTDIWAANT

SEQ ID NO: 12690 - protein, 120 aa, Homo sapiens
  Payload ID: 2484
  Gene Symbol: CTIF
  Gene Name: CBP80/20-dependent translation initiation factor
  ENSP ID: ENSP00000467965
MENSSAASASSEAGSSRSQEIEELERFIDSYVLEYQVQGLLADKTEGDGESERTQSHISQEEVLNGGPPMKGLTEEWTADCSEPLDSSCSFSRGRAPPQQNGSKDNSLDMLGTDIWAANT

SEQ ID NO: 12691 - protein, 120 aa, Homo sapiens; identical to SEQ ID NO: 12690
  Payload ID: 2484
  Gene Symbol: CTIF
  Gene Name: CBP80/20-dependent translation initiation factor
  ENSP ID: ENSP00000488966

SEQ ID NO: 12692 - protein, 194 aa, Homo sapiens; identical to SEQ ID NO: 12687
  Payload ID: 2484
  Gene Symbol: CTIF
  Gene Name: CBP80/20-dependent translation initiation factor
  ENSP ID: ENSP00000489151

SEQ ID NO: 12693 - protein, 104 aa, Homo sapiens; identical to SEQ ID NO: 12689
  Payload ID: 2484
  Gene Symbol: CTIF
  Gene Name: CBP80/20-dependent translation initiation factor
  ENSP ID: ENSP00000489209

SEQ ID NO: 12694 - protein, 600 aa, Homo sapiens; identical to SEQ ID NO: 12686
  Payload ID: 2484
  Gene Symbol: CTIF
  Gene Name: CBP80/20-dependent translation initiation factor
  ENSP ID: ENSP00000489354

SEQ ID NO: 12695 - protein, 138 aa, Homo sapiens; identical to SEQ ID NO: 12688
  Payload ID: 2484
  Gene Symbol: CTIF
  Gene Name: CBP80/20-dependent translation initiation factor
  ENSP ID: ENSP00000489577

SEQ ID NO: 12696 - protein, 598 aa, Homo sapiens; identical to SEQ ID NO: 12685
  Payload ID: 2484
  Gene Symbol: CTIF
  Gene Name: CBP80/20-dependent translation initiation factor
  ENSP ID: ENSP00000489589

SEQ ID NO: 12697 - protein, 358 aa, Homo sapiens
  Payload ID: 2485
  Gene Symbol: CEBPA
  Gene Name: CCAAT/enhancer binding protein (C/EBP), alpha
  Uniprot ID: P49715
  ENSP ID: ENSP00000427514
MESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 12698 - protein, 345 aa, Homo sapiens
  Payload ID: 2486
  Gene Symbol: CEBPB
  Gene Name: CCAAT/enhancer binding protein (C/EBP), beta
  Uniprot ID: P17676
  ENSP ID: ENSP00000305422
MQRLVAWDPACLPLPPPPPAFKSMEVANFYYEADCLAAAYGGKAAPAAPPAARPGPRPPAGELGSIGDHERAIDFSPYLEPLGAPQAPAPATATDTFEAAPPAPAPAPASSGQHHDFLSDLFSDDYGGKNCKKPAEYGYVSLGRLGAAKGALHPGCFAPLHPPPPPPPPPAELKAEPGFEPADCKRKEEAGAPGGGAGMAAGFPYALRAYLGYQAVPSGSSGSLSTSSSSSPPGTPSPADAKAPPTACYAGAAPAPSQVKSKAKKTVDKHSDEYKIRRERNNIAVRKSRDKAKMRNLETQHKVLELTAENERLQKKVEQLSRELSTLRNLFKQLPEPLLASSGHC

SEQ ID NO: 12699 - protein, 269 aa, Homo sapiens
  Payload ID: 2487
  Gene Symbol: CEBPD
  Gene Name: CCAAT/enhancer binding protein (C/EBP), delta
  Uniprot ID: P49716
  ENSP ID: ENSP00000386165
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 12700 - protein, 281 aa, Homo sapiens
  Payload ID: 2488
  Gene Symbol: CEBPE
  Gene Name: CCAAT/enhancer binding protein (C/EBP), epsilon
  Uniprot ID: Q15744
  ENSP ID: ENSP00000206513
MSHGTYYECEPRGGQQPLEFSGGRAGPGELGDMCEHEASIDLSAYIESGEEQLLSDLFAVKPAPEARGLKGPGTPAFPHYLPPDPRPFAYPPHTFGPDRKALGPGIYSSPGSYDPRAVAVKEEPRGPEGSRAASRGSYNPLQYQVAHCGQTAMHLPPTLAAPGQPLRVLKAPLATAAPPCSPLLKAPSPAGPLHKGKKAVNKDSLEYRLRRERNNIAVRKSRDKAKRRILETQQKVLEYMAENERLRSRVEQLTQELDTLRNLFRQIPEAANLIKGVGGCS

SEQ ID NO: 12701 - protein, 150 aa, Homo sapiens
  Payload ID: 2489
  Gene Symbol: CEBPG
  Gene Name: CCAAT/enhancer binding protein (C/EBP), gamma
  Uniprot ID: P53567
  ENSP ID: ENSP00000284000
MSKISQQNSTPGVNGISVIHTQAHASGLQQVPQLVPAGPGGGGKAVAPSKQSKKSSPMDRNSDEYRQRRERNNMAVKKSRLKSKQKAQDTLQRVNQLKEENERLEAKIKLLTKELSVLKDLFLEHAHNLADNVQSISTENTTADGDNAGQ

SEQ ID NO: 12702 - protein, 150 aa, Homo sapiens; identical to SEQ ID NO: 12701
  Payload ID: 2489
  Gene Symbol: CEBPG
  Gene Name: CCAAT/enhancer binding protein (C/EBP), gamma
  Uniprot ID: P53567
  ENSP ID: ENSP00000466022

SEQ ID NO: 12703 - protein, 1054 aa, Homo sapiens
  Payload ID: 2490
  Gene Symbol: CEBPZ
  Gene Name: CCAAT/enhancer binding protein (C/EBP), zeta
  Uniprot ID: Q03701
  ENSP ID: ENSP00000234170
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIGMNAMANKDNASLKQLRWEAERDDWLHNRDAKSIIKKKKHFKKKRIKTTQKTKKQRK

SEQ ID NO: 12704 - protein, 146 aa, Homo sapiens
  Payload ID: 2490
  Gene Symbol: CEBPZ
  Gene Name: CCAAT/enhancer binding protein (C/EBP), zeta
  ENSP ID: ENSP00000391881
MCSQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLK

SEQ ID NO: 12705 - protein, 998 aa, Homo sapiens
  Payload ID: 2490
  Gene Symbol: CEBPZ
  Gene Name: CCAAT/enhancer binding protein (C/EBP), zeta
  ENSP ID: ENSP00000484333
MAAVKEPLEFHAKRPWRPEEAVEDPDEEDEDNTSEAENGFSLEEVLRLGGTKQDYLMLATLDENEEVIDGGKKGAIDDLQQGELEAFIQNLNLAKYTKASLVEEDEPAEKENSSKKEVKIPKINNKNTAESQRTSVNKVKNKNRPEPHSDENGSTTPKVKKDKQNIFEFFERQTLLLRPGGKWYDLEYSNEYSLKPQPQDVVSKYKTLAQKLYQHEINLFKSKTNSQKGASSTWMKAIVSSGTLGDRMAAMILLIQDDAVHTLQFVETLVNLVKKKGSKQQCLMALDTFKELLITDLLPDNRKLRIFSQRPFDKLEQLSSGNKDSRDRRLILWYFEHQLKHLVAEFVQVLETLSHDTLVTTKTRALTVAHELLCNKPEEEKALLVQVVNKLGDPQNRIATKASHLLETLLCKHPNMKGVVSGEVERLLFRSNISSKAQYYAICFLNQMALSHEESELANKLITVYFCFFRTCVKKKDVESKMLSALLTGVNRAYPYSQTGDDKVREQIDTLFKVLHIVNFNTSVQALMLLFQVMNSQQTISDRYYTALYRKMLDPGLMTCSKQAMFLNLVYKSLKADIVLRRVKAFVKRLLQVTCQQMPPFICGALYLVSEILKAKPGLRSQLDDHPESDDEENFIDANDDEDMEKFTDADKETEIVKKLETEETVPETDVETKKPEVASWVHFDNLKGGKQLNKYDPFSRNPLFCGAENTSLWELKKLSVHFHPSVALFAKTILQGNYIQYSGDPLQDFTLMRFLDRFVYRNPKPHKGKENTDSVVMQPKRKHFIKDIRHLPVNSKEFLAKEESQIPVDEVFFHRYYKKVAVKEKQKRDADEESIEDVDDEEFEELIDTFEDDNCFSSGKDDMDFAGNVKKRTKGAKDNTLDEDSEGSDDELGNLDDDEVSLGSMDDEEFAEVDEDGGTFMDVLDDESESVPELEVHSKVSTKKSKRKGTDDFDFAGSFQGPRKKKRNLNDSSLFVSAEEFGHLLDENMGSKFDNIA

SEQ ID NO: 12706 - protein, 727 aa, Homo sapiens
  Payload ID: 2491
  Gene Symbol: CTCF
  Gene Name: CCCTC-binding  factor (zinc finger protein)
  Uniprot ID: P49711
  ENSP ID: ENSP00000264010
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPTKIKKKGVKKTFQCELCSYTCPRRSNLDRHMKSHTDERPHKCHLCGRAFRTVTLLRNHLNTHTGTRPHKCPDCDMAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 12707 - protein, 399 aa, Homo sapiens
  Payload ID: 2491
  Gene Symbol: CTCF
  Gene Name: CCCTC-binding  factor (zinc finger protein)
  Uniprot ID: P49711
  ENSP ID: ENSP00000384707
MAFVTSGELVRHRRYKHTHEKPFKCSMCDYASVEVSKLKRHIRSHTGERPFQCSLCSYASRDTYKLKRHMRTHSGEKPYECYICHARFTQSGTMKMHILQKHTENVAKFHCPHCDTVIARKSDLGVHLRKQHSYIEQGKKCRYCDAVFHERYALIQHQKSHKNEKRFKCDQCDYACRQERHMIMHKRTHTGEKPYACSHCDKTFRQKQLLDMHFKRYHDPNFVPAAFVCSKCGKTFTRRNTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPTAIIQVEDQNTGAIENIIVEVKKEPDAEPAEGEEEEAQPAATDAPNGDLTPEMILSMMDR

SEQ ID NO: 12708 - protein, 663 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000243914
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 12709 - protein, 663 aa, Homo sapiens; identical to SEQ ID NO: 12708
  Payload ID: 2492
  Gene Symbol: CTCFL
  Gene Name: CCCTC-binding  factor (zinc finger protein)-like
  Uniprot ID: Q8NI51
  ENSP ID: ENSP00000360239

SEQ ID NO: 12710 - protein, 460 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000392034
MSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 12711 - protein, 573 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000399061
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWITSKWSGLKPQTFIT

SEQ ID NO: 12712 - protein, 451 aa, Homo sapiens
  Payload ID: 2492
  Gene Symbol: CTCFL
  Gene Name: CCCTC-binding  factor (zinc finger protein)-like
  ENSP ID: ENSP00000403369
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRFLGLPFP

SEQ ID NO: 12713 - protein, 483 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000409344
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 12714 - protein, 427 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000413713
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSEATSKRSLQEIPRCKFHPDCLQMLQVWQRLFPLD

SEQ ID NO: 12715 - protein, 613 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000415329
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 12716 - protein, 700 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000415579
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDNSAGCTGRMMLVSAWLLGRPQETYNQGRRRRGSRRVTW

SEQ ID NO: 12717 - protein, 403 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000437999
MFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 12718 - protein, 422 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000439998
MSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 12719 - protein, 663 aa, Homo sapiens; identical to SEQ ID NO: 12708
  Payload ID: 2492
  Gene Symbol: CTCFL
  Gene Name: CCCTC-binding  factor (zinc finger protein)-like
  Uniprot ID: Q8NI51
  ENSP ID: ENSP00000476398

SEQ ID NO: 12720 - protein, 627 aa, Homo sapiens
  Payload ID: 2492
  Gene Symbol: CTCFL
  Gene Name: CCCTC-binding  factor (zinc finger protein)-like
  ENSP ID: ENSP00000476458
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWILWVGNSEVAELGGPGSGPLLRLQSGCPPGLHHPKAGLGPEDPLPGQLRHTTAGTGLSSLLQGPLCRAA

SEQ ID NO: 12721 - protein, 404 aa, Homo sapiens
  Payload ID: 2492
  Gene Symbol: CTCFL
  Gene Name: CCCTC-binding  factor (zinc finger protein)-like
  ENSP ID: ENSP00000476577
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEVKPFLDLKLHGILVEAAVQVTPSVTNSRICYKQAFYYSYKIYAGNNMHSLL

SEQ ID NO: 12722 - protein, 299 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000476718
MFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWVLY

SEQ ID NO: 12723 - protein, 663 aa, Homo sapiens; identical to SEQ ID NO: 12708
  Payload ID: 2492
  Gene Symbol: CTCFL
  Gene Name: CCCTC-binding  factor (zinc finger protein)-like
  Uniprot ID: Q8NI51
  ENSP ID: ENSP00000476783

SEQ ID NO: 12724 - protein, 404 aa, Homo sapiens; identical to SEQ ID NO: 12721
  Payload ID: 2492
  Gene Symbol: CTCFL
  Gene Name: CCCTC-binding  factor (zinc finger protein)-like
  ENSP ID: ENSP00000477165

SEQ ID NO: 12725 - protein, 426 aa, Homo sapiens
  Payload ID: 2492
  Gene Symbol: CTCFL
  Gene Name: CCCTC-binding  factor (zinc finger protein)-like
  ENSP ID: ENSP00000477412
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGKGSGAEGLIPTVLTLKASFKKLLFIGTIKVQR

SEQ ID NO: 12726 - protein, 665 aa, Homo sapiens
  Payload ID: 2492
  Gene Symbol: CTCFL
  Gene Name: CCCTC-binding  factor (zinc finger protein)-like
  Uniprot ID: Q8NI51
  ENSP ID: ENSP00000477488
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDGVISAHRNLCLLGSSDSHASVSGAGITDARHHAWLIVLLFLVEMGFYHVSHS

SEQ ID NO: 12727 - protein, 502 aa, Homo sapiens
  Payload ID: 2493
  Gene Symbol: CCDC169-SOHLH2
  Gene Name: CCDC169-SOHLH2 readthrough
  ENSP ID: ENSP00000421868
METLQESLNTLLKQLEEEKKTLESQVKYYALKLEQESKAYQKINNERRTYLAEMSQGSGLHQVSKRQQVDQLPRMQENLVKTLLLKEELDPLKAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLTNTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 12728 - protein, 178 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000399488
MSSNECFKCGRSGHWARECPTGGGRGRGMRSRGRGGFTSDRGFQFVSSSLPDICYRCGESGHLAKDCDLQEDEACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12729 - protein, 172 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000400444
MSSNECFKCGRSGHWARECPTGGGRGRGMRSRGRGFQFVSSSLPDICYRCGESGHLAKDCDLQEDVEACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12730 - protein, 177 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000410619
MSSNECFKCGRSGHWARECPTGGGRGRGMRSRGRGGFTSDRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12731 - protein, 179 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000410769
MSSNECFKCGRSGHWARECPTGGGRGRGMRSRGRGGFTSDRGFQFVSSSLPDICYRCGESGHLAKDCDLQEDVEACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12732 - protein, 170 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000421323
MSSNECFKCGRSGHWARECPTGGGRGRGMRSRGRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12733 - protein, 167 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000422110
MSSNECFKCGRSGHWARECPTGGGRGRGMRSRGRGGFTSDRDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12734 - protein, 113 aa, Homo sapiens
  Payload ID: 2494
  Gene Symbol: CNBP
  Gene Name: CCHC-type zinc finger, nucleic acid binding protein
  ENSP ID: ENSP00000424787
MSSNECFKCGRSGHWARECPTGGGRGRGMRSRGRGGFQFVSSSLPDICYRCGESGHLAKDCDLQEDVLACFFSLLLKPAITAVEVATLPRTARSPRESESNAATTVANQAIWL

SEQ ID NO: 12735 - protein, 160 aa, Homo sapiens
  Payload ID: 2494
  Gene Symbol: CNBP
  Gene Name: CCHC-type zinc finger, nucleic acid binding protein
  Uniprot ID: P62633
  ENSP ID: ENSP00000426223
MSSNECFKCGRSGHWARECPTGGGRGRGMRSRGRDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGHLARECTIEATA

SEQ ID NO: 12736 - protein, 113 aa, Homo sapiens
  Payload ID: 2495
  Gene Symbol: CCL15-CCL14
  Gene Name: CCL15-CCL14 readthrough (NMD candidate)
  ENSP ID: ENSP00000481402
MKVSVAALSCLMLVAVLGSQAQFTNDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 12737 - protein, 113 aa, Homo sapiens; identical to SEQ ID NO: 12736
  Payload ID: 2495
  Gene Symbol: CCL15-CCL14
  Gene Name: CCL15-CCL14 readthrough (NMD candidate)
  ENSP ID: ENSP00000481940

SEQ ID NO: 12738 - protein, 113 aa, Homo sapiens
  Payload ID: 2495
  Gene Symbol: CCL15-CCL14
  Gene Name: CCL15-CCL14 readthrough (NMD candidate)
  ENSP ID: ENSP00000487982
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 12739 - protein, 113 aa, Homo sapiens; identical to SEQ ID NO: 12738
  Payload ID: 2495
  Gene Symbol: CCL15-CCL14
  Gene Name: CCL15-CCL14 readthrough (NMD candidate)
  ENSP ID: ENSP00000488638

SEQ ID NO: 12740 - protein, 316 aa, Homo sapiens
  Payload ID: 2496
  Gene Symbol: CNOT1
  Gene Name: CCR4-NOT transcription complex, subunit 1
  ENSP ID: ENSP00000245138
MLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQSGTQIATLTTSVAPCCTFLQRPIRKPSKNRSQEFSWNG

SEQ ID NO: 12741 - protein, 2376 aa, Homo sapiens
  Payload ID: 2496
  Gene Symbol: CNOT1
  Gene Name: CCR4-NOT transcription complex, subunit 1
  Uniprot ID: A5YKK6
  ENSP ID: ENSP00000320949
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 12742 - protein, 1551 aa, Homo sapiens
  Payload ID: 2496
  Gene Symbol: CNOT1
  Gene Name: CCR4-NOT transcription complex, subunit 1
  Uniprot ID: A5YKK6
  ENSP ID: ENSP00000413113
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRVSWLFPWYRYKTYYCLSVIIFFFVYIWHWALPLILNNHHICLMSSIILDCNSVRQSIMSVCFFFFLLYSQHDV

SEQ ID NO: 12743 - protein, 277 aa, Homo sapiens
  Payload ID: 2496
  Gene Symbol: CNOT1
  Gene Name: CCR4-NOT transcription complex, subunit 1
  ENSP ID: ENSP00000454377
RREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPGGLGTGSLTGIGTGALGLPAVNNDPFVQRKLGTSGLNQPTFQQSKMKPSDLSQVWPEANQHFSKEIDDEANSYFQRIYNHPPHPTMSVDE

SEQ ID NO: 12744 - protein, 439 aa, Homo sapiens
  Payload ID: 2496
  Gene Symbol: CNOT1
  Gene Name: CCR4-NOT transcription complex, subunit 1
  ENSP ID: ENSP00000454611
PTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQVELLERKMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQK

SEQ ID NO: 12745 - protein, 185 aa, Homo sapiens
  Payload ID: 2496
  Gene Symbol: CNOT1
  Gene Name: CCR4-NOT transcription complex, subunit 1
  ENSP ID: ENSP00000454763
  MOD_RES (1)..(1): Any amino acid
XAELHQEHDLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALR

SEQ ID NO: 12746 - protein, 25 aa, Homo sapiens
  Payload ID: 2496
  Gene Symbol: CNOT1
  Gene Name: CCR4-NOT transcription complex, subunit 1
  ENSP ID: ENSP00000455289
MNLDSLSLALSQISYLVDNLTKKNY

SEQ ID NO: 12747 - protein, 2371 aa, Homo sapiens
  Payload ID: 2496
  Gene Symbol: CNOT1
  Gene Name: CCR4-NOT transcription complex, subunit 1
  Uniprot ID: A5YKK6
  ENSP ID: ENSP00000455635
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 12748 - protein, 193 aa, Homo sapiens
  Payload ID: 2496
  Gene Symbol: CNOT1
  Gene Name: CCR4-NOT transcription complex, subunit 1
  ENSP ID: ENSP00000456131
  MOD_RES (1)..(1): Any amino acid
XSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEYPDKELHITACLFGGIIEKGLVTYMALGLALRYVLEALRKPFGSKMYYFGIAALDRFKNRLKDYPQYCQHLASISHFMQFPHHLQEYIEYGQQSRD

SEQ ID NO: 12749 - protein, 2150 aa, Homo sapiens
  Payload ID: 2496
  Gene Symbol: CNOT1
  Gene Name: CCR4-NOT transcription complex, subunit 1
  Uniprot ID: A5YKK6
  ENSP ID: ENSP00000456649
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQTDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKSLTL

SEQ ID NO: 12750 - protein, 62 aa, Homo sapiens
  Payload ID: 2496
  Gene Symbol: CNOT1
  Gene Name: CCR4-NOT transcription complex, subunit 1
  ENSP ID: ENSP00000456975
MNLDSLSLALSQISYLVDNLTKKNYRASQQEIQHIVNRHGPEADRHLLRCLFSHVDFSGDGK

SEQ ID NO: 12751 - protein, 68 aa, Homo sapiens
  Payload ID: 2496
  Gene Symbol: CNOT1
  Gene Name: CCR4-NOT transcription complex, subunit 1
  ENSP ID: ENSP00000457173
  MOD_RES (1)..(1): Any amino acid
XKIAMTTCEQIVRKDFALDSEESRMRIAAHHMMRNLTAGMAMITCREPLLMSISTNLKNSFASALREG

SEQ ID NO: 12752 - protein, 96 aa, Homo sapiens
  Payload ID: 2496
  Gene Symbol: CNOT1
  Gene Name: CCR4-NOT transcription complex, subunit 1
  ENSP ID: ENSP00000457460
MNLDSLSLALSQISYLVDNLTKKNYRASQQEIQHIVNRHGPEADRHLLRCLFSHVDFSGDGKSSGKDFHQTQFLIQECALLITKPNCLEYLMWPRT

SEQ ID NO: 12753 - protein, 25 aa, Homo sapiens
  Payload ID: 2496
  Gene Symbol: CNOT1
  Gene Name: CCR4-NOT transcription complex, subunit 1
  ENSP ID: ENSP00000457869
MNLDSLSLALSQISYLVDNLTKKNY

SEQ ID NO: 12754 - protein, 241 aa, Homo sapiens
  Payload ID: 2496
  Gene Symbol: CNOT1
  Gene Name: CCR4-NOT transcription complex, subunit 1
  ENSP ID: ENSP00000458057
  MOD_RES (1)..(1): Any amino acid
XITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKDLDVKSLLLEAYVKGQQELLYVVPFVAKVLESSIRSVVFRPPNPWTMAIMNVLAELHQEHDLKLNLKFEIEVLC

SEQ ID NO: 12755 - protein, 96 aa, Homo sapiens; identical to SEQ ID NO: 12752
  Payload ID: 2496
  Gene Symbol: CNOT1
  Gene Name: CCR4-NOT transcription complex, subunit 1
  ENSP ID: ENSP00000485782

SEQ ID NO: 12756 - protein, 717 aa, Homo sapiens
  Payload ID: 2497
  Gene Symbol: CNOT10
  Gene Name: CCR4-NOT transcription complex, subunit 10
  Uniprot ID: Q9H9A5
  ENSP ID: ENSP00000329376
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCRCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 12757 - protein, 744 aa, Homo sapiens
  Payload ID: 2497
  Gene Symbol: CNOT10
  Gene Name: CCR4-NOT transcription complex, subunit 10
  Uniprot ID: Q9H9A5
  ENSP ID: ENSP00000330060
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 12758 - protein, 43 aa, Homo sapiens
  Payload ID: 2497
  Gene Symbol: CNOT10
  Gene Name: CCR4-NOT transcription complex, subunit 10
  ENSP ID: ENSP00000392312
GLDDVENSMLYYNQAVILYHLRQYTEAISVGEKLYQFIEPFDW

SEQ ID NO: 12759 - protein, 229 aa, Homo sapiens
  Payload ID: 2497
  Gene Symbol: CNOT10
  Gene Name: CCR4-NOT transcription complex, subunit 10
  ENSP ID: ENSP00000395385
PVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQAGKRAPQCYPSSVNSARTVMLFNLGSAYCLRSEYDKARKCLHQAASMIHPKEVPPEAILLAVYLELQNG

SEQ ID NO: 12760 - protein, 804 aa, Homo sapiens
  Payload ID: 2497
  Gene Symbol: CNOT10
  Gene Name: CCR4-NOT transcription complex, subunit 10
  Uniprot ID: Q9H9A5
  ENSP ID: ENSP00000399862
MKSIGVKTVKVCGSKSSVRIEGQPCSLGQSRRKVKLMGERSYTLSIGNGDYFWANKEMLWDYVQTLSDQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 12761 - protein, 609 aa, Homo sapiens
  Payload ID: 2497
  Gene Symbol: CNOT10
  Gene Name: CCR4-NOT transcription complex, subunit 10
  ENSP ID: ENSP00000402795
MAADKPADQGAEKHEGTGQSSGITDQEKELSTNAFQAFTVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCRCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAQWLMPPSTLGGRGRRIMRSGV

SEQ ID NO: 12762 - protein, 210 aa, Homo sapiens
  Payload ID: 2497
  Gene Symbol: CNOT10
  Gene Name: CCR4-NOT transcription complex, subunit 10
  ENSP ID: ENSP00000402979
  MOD_RES (1)..(1): Any amino acid
XYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNVNA

SEQ ID NO: 12763 - protein, 510 aa, Homo sapiens
  Payload ID: 2498
  Gene Symbol: CNOT11
  Gene Name: CCR4-NOT transcription complex, subunit 11
  Uniprot ID: Q9UKZ1
  ENSP ID: ENSP00000289382
MPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQNRLVRLVCVFLQSLIRNKIINVQDLFIEVQAFCIEFSRIREAAGLFRLLKTLDTGETPSETKMSK

SEQ ID NO: 12764 - protein, 127 aa, Homo sapiens
  Payload ID: 2498
  Gene Symbol: CNOT11
  Gene Name: CCR4-NOT transcription complex, subunit 11
  ENSP ID: ENSP00000394203
  MOD_RES (1)..(1): Any amino acid
XTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQVI

SEQ ID NO: 12765 - protein, 540 aa, Homo sapiens
  Payload ID: 2499
  Gene Symbol: CNOT2
  Gene Name: CCR4-NOT transcription complex, subunit 2
  Uniprot ID: Q9NZN8
  ENSP ID: ENSP00000229195
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 12766 - protein, 540 aa, Homo sapiens; identical to SEQ ID NO: 12765
  Payload ID: 2499
  Gene Symbol: CNOT2
  Gene Name: CCR4-NOT transcription complex, subunit 2
  Uniprot ID: Q9NZN8
  ENSP ID: ENSP00000412091

SEQ ID NO: 12767 - protein, 186 aa, Homo sapiens
  Payload ID: 2499
  Gene Symbol: CNOT2
  Gene Name: CCR4-NOT transcription complex, subunit 2
  ENSP ID: ENSP00000446507
  MOD_RES (1)..(1): Any amino acid
XPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELYVQSILITFVL

SEQ ID NO: 12768 - protein, 309 aa, Homo sapiens
  Payload ID: 2499
  Gene Symbol: CNOT2
  Gene Name: CCR4-NOT transcription complex, subunit 2
  ENSP ID: ENSP00000447497
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETD

SEQ ID NO: 12769 - protein, 104 aa, Homo sapiens
  Payload ID: 2499
  Gene Symbol: CNOT2
  Gene Name: CCR4-NOT transcription complex, subunit 2
  ENSP ID: ENSP00000447808
PSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKVYFFPCANV

SEQ ID NO: 12770 - protein, 46 aa, Homo sapiens
  Payload ID: 2499
  Gene Symbol: CNOT2
  Gene Name: CCR4-NOT transcription complex, subunit 2
  ENSP ID: ENSP00000447813
  MOD_RES (1)..(1): Any amino acid
XLYPKFASPWASSPCRPQDIDFHVPSEYLTNIHIRDKLFFFFSWLQ

SEQ ID NO: 12771 - protein, 196 aa, Homo sapiens
  Payload ID: 2499
  Gene Symbol: CNOT2
  Gene Name: CCR4-NOT transcription complex, subunit 2
  ENSP ID: ENSP00000448024
MFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGT

SEQ ID NO: 12772 - protein, 36 aa, Homo sapiens
  Payload ID: 2499
  Gene Symbol: CNOT2
  Gene Name: CCR4-NOT transcription complex, subunit 2
  ENSP ID: ENSP00000448255
MVRTDGHTLSEKRNYQSGRIPSFIMFWLDFLTVCWS

SEQ ID NO: 12773 - protein, 182 aa, Homo sapiens
  Payload ID: 2499
  Gene Symbol: CNOT2
  Gene Name: CCR4-NOT transcription complex, subunit 2
  ENSP ID: ENSP00000448298
  MOD_RES (1)..(1): Any amino acid
XTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELYVQILTVIGDTTKKNEYGLPGHQAWSQQ

SEQ ID NO: 12774 - protein, 54 aa, Homo sapiens
  Payload ID: 2499
  Gene Symbol: CNOT2
  Gene Name: CCR4-NOT transcription complex, subunit 2
  ENSP ID: ENSP00000448453
MVRTDGHTLSEKRNYQPPALSFPIPRVANVERSCTGDKQHVWCFKKEVCRGGRQ

SEQ ID NO: 12775 - protein, 276 aa, Homo sapiens
  Payload ID: 2499
  Gene Symbol: CNOT2
  Gene Name: CCR4-NOT transcription complex, subunit 2
  ENSP ID: ENSP00000448490
MVRTDGHTLSEKRNYQVTNSMFGASRKKFVEGVDSDYHDENMYYSQSSMFPHRSEKDMLASPSTSGQLSQFGASLYGQQNGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDI

SEQ ID NO: 12776 - protein, 68 aa, Homo sapiens
  Payload ID: 2499
  Gene Symbol: CNOT2
  Gene Name: CCR4-NOT transcription complex, subunit 2
  ENSP ID: ENSP00000448660
MLKEVAQVTNSMFGASRKKFVEGVDSDYHDENMYYSQSSMFPHRSEKDMLASPSTSGQLSQFGASLYG

SEQ ID NO: 12777 - protein, 99 aa, Homo sapiens
  Payload ID: 2499
  Gene Symbol: CNOT2
  Gene Name: CCR4-NOT transcription complex, subunit 2
  ENSP ID: ENSP00000448808
  MOD_RES (1)..(1): Any amino acid
XHLALGSDLTTLGLNLNSPENLYPKFASPWASSPCRPQDIDFHVPSEYLTNIHIRDKLAAIKLGRYGEDLLFYLYYMNGGDVLQLLAAVELSSIWNMTN

SEQ ID NO: 12778 - protein, 191 aa, Homo sapiens
  Payload ID: 2499
  Gene Symbol: CNOT2
  Gene Name: CCR4-NOT transcription complex, subunit 2
  Uniprot ID: Q9NZN8
  ENSP ID: ENSP00000448883
MVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 12779 - protein, 36 aa, Homo sapiens; identical to SEQ ID NO: 12772
  Payload ID: 2499
  Gene Symbol: CNOT2
  Gene Name: CCR4-NOT transcription complex, subunit 2
  ENSP ID: ENSP00000449084

SEQ ID NO: 12780 - protein, 540 aa, Homo sapiens; identical to SEQ ID NO: 12765
  Payload ID: 2499
  Gene Symbol: CNOT2
  Gene Name: CCR4-NOT transcription complex, subunit 2
  Uniprot ID: Q9NZN8
  ENSP ID: ENSP00000449260

SEQ ID NO: 12781 - protein, 76 aa, Homo sapiens
  Payload ID: 2499
  Gene Symbol: CNOT2
  Gene Name: CCR4-NOT transcription complex, subunit 2
  ENSP ID: ENSP00000449385
MVRTDGHTLSEKRNYQPPALSFPIPRVANVERSCTDVVSLCHPGWTAVASSWLTATSASQVQVILLPRPPSSWDYR

SEQ ID NO: 12782 - protein, 217 aa, Homo sapiens
  Payload ID: 2499
  Gene Symbol: CNOT2
  Gene Name: CCR4-NOT transcription complex, subunit 2
  ENSP ID: ENSP00000449446
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNRNQAFGMNNSLSSNIFNGTDGSENVTGL

SEQ ID NO: 12783 - protein, 182 aa, Homo sapiens
  Payload ID: 2499
  Gene Symbol: CNOT2
  Gene Name: CCR4-NOT transcription complex, subunit 2
  ENSP ID: ENSP00000449577
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPS

SEQ ID NO: 12784 - protein, 531 aa, Homo sapiens
  Payload ID: 2499
  Gene Symbol: CNOT2
  Gene Name: CCR4-NOT transcription complex, subunit 2
  ENSP ID: ENSP00000449659
MLKEVAQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 12785 - protein, 81 aa, Homo sapiens
  Payload ID: 2499
  Gene Symbol: CNOT2
  Gene Name: CCR4-NOT transcription complex, subunit 2
  ENSP ID: ENSP00000449801
MFGASRKKFVEGVDSDYHDENMYYSQSSMFPHRSEKDMLASPSTSGQLSQFGASLYGQQSALGLPMRGMSNNTPQLNRSLS

SEQ ID NO: 12786 - protein, 62 aa, Homo sapiens
  Payload ID: 2499
  Gene Symbol: CNOT2
  Gene Name: CCR4-NOT transcription complex, subunit 2
  ENSP ID: ENSP00000449917
MVRTDGHTLSEKRNYQVTNSMFGASRKKFVEGVDSDYHDENMYYSQSSMFPHRSEKDTEVKM

SEQ ID NO: 12787 - protein, 144 aa, Homo sapiens
  Payload ID: 2499
  Gene Symbol: CNOT2
  Gene Name: CCR4-NOT transcription complex, subunit 2
  ENSP ID: ENSP00000450077
MLKEVAQVTNSMFGASRKKFVEGVDSDYHDENMYYSQSSMFPHRSEKDMLASPSTSGQLSQFGASLYGQQNGSENVTGLDLSDFPALADRNRREGSGNPTPLINPLAGRAPYVGMVTKPANEQSQDFSIHNEDFPALPGSSYKD

SEQ ID NO: 12788 - protein, 131 aa, Homo sapiens
  Payload ID: 2499
  Gene Symbol: CNOT2
  Gene Name: CCR4-NOT transcription complex, subunit 2
  ENSP ID: ENSP00000450090
MRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGT

SEQ ID NO: 12789 - protein, 25 aa, Homo sapiens
  Payload ID: 2499
  Gene Symbol: CNOT2
  Gene Name: CCR4-NOT transcription complex, subunit 2
  ENSP ID: ENSP00000450283
MVRTDGHTLSEKRNYQVTNSMFGAS

SEQ ID NO: 12790 - protein, 321 aa, Homo sapiens
  Payload ID: 2499
  Gene Symbol: CNOT2
  Gene Name: CCR4-NOT transcription complex, subunit 2
  ENSP ID: ENSP00000450318
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDK

SEQ ID NO: 12791 - protein, 152 aa, Homo sapiens
  Payload ID: 2499
  Gene Symbol: CNOT2
  Gene Name: CCR4-NOT transcription complex, subunit 2
  ENSP ID: ENSP00000483096
  MOD_RES (1)..(1): Any amino acid
XENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPRNMMNHSQVGQGIGIPSRTNSMSSSGLGSPNRSSPSIICMPKQQPSRQPFTVNR

SEQ ID NO: 12792 - protein, 753 aa, Homo sapiens
  Payload ID: 2500
  Gene Symbol: CNOT3
  Gene Name: CCR4-NOT transcription complex, subunit 3
  Uniprot ID: O75175
  ENSP ID: ENSP00000221232
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 12793 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000351159

SEQ ID NO: 12794 - protein, 375 aa, Homo sapiens
  Payload ID: 2500
  Gene Symbol: CNOT3
  Gene Name: CCR4-NOT transcription complex, subunit 3
  ENSP ID: ENSP00000398463
  MOD_RES (1)..(1): Any amino acid
XRKLIETQMERFKVVERETKTKAYSKEGLGLAQKVDPAQKEKEEVGQWLTNTIDTLNMQVDQFESEVESLSVQTRKKKGDKDQKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQ

SEQ ID NO: 12795 - protein, 288 aa, Homo sapiens
  Payload ID: 2500
  Gene Symbol: CNOT3
  Gene Name: CCR4-NOT transcription complex, subunit 3
  ENSP ID: ENSP00000401703
  MOD_RES (1)..(1): Any amino acid
XKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQLAQSLSLTKYSSLWLSAQPGTPPSHPPLGQLLGLL

SEQ ID NO: 12796 - protein, 571 aa, Homo sapiens
  Payload ID: 2500
  Gene Symbol: CNOT3
  Gene Name: CCR4-NOT transcription complex, subunit 3
  ENSP ID: ENSP00000411587
MLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEPRDVRTAWVDSEAGPLRHTSAPLPVAHWLTRGPSPALLQQPQSRPTPLCSLAHSQASLETTGELSSPLPTPLL

SEQ ID NO: 12797 - protein, 88 aa, Homo sapiens
  Payload ID: 2500
  Gene Symbol: CNOT3
  Gene Name: CCR4-NOT transcription complex, subunit 3
  ENSP ID: ENSP00000420064
AQYLAAKALKKQSWRFHTKYMMWFQRHEEPKTITDEFEQIPDHLLVHSLTAFSPGQGTYIYFDYEKWGQRKKEGFTFEYRYLEDRDLQ

SEQ ID NO: 12798 - protein, 571 aa, Homo sapiens
  Payload ID: 2500
  Gene Symbol: CNOT3
  Gene Name: CCR4-NOT transcription complex, subunit 3
  Uniprot ID: O75175
  ENSP ID: ENSP00000477620
MLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEPRDVRTAWVDSEAGPLRHTSAPLPVAHWLTRGPSPALLQQPQSRPTPLCSSAHSQASLETTGELSSPLPTPLL

SEQ ID NO: 12799 - protein, 571 aa, Homo sapiens; identical to SEQ ID NO: 12798
  Payload ID: 2500
  Gene Symbol: CNOT3
  Gene Name: CCR4-NOT transcription complex, subunit 3
  ENSP ID: ENSP00000477693

SEQ ID NO: 12800 - protein, 571 aa, Homo sapiens; identical to SEQ ID NO: 12798
  Payload ID: 2500
  Gene Symbol: CNOT3
  Gene Name: CCR4-NOT transcription complex, subunit 3
  Uniprot ID: O75175
  ENSP ID: ENSP00000478143

SEQ ID NO: 12801 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000478280

SEQ ID NO: 12802 - protein, 288 aa, Homo sapiens; identical to SEQ ID NO: 12795
  Payload ID: 2500
  Gene Symbol: CNOT3
  Gene Name: CCR4-NOT transcription complex, subunit 3
  ENSP ID: ENSP00000478423
  MOD_RES (1)..(1): Any amino acid

SEQ ID NO: 12803 - protein, 571 aa, Homo sapiens; identical to SEQ ID NO: 12798
  Payload ID: 2500
  Gene Symbol: CNOT3
  Gene Name: CCR4-NOT transcription complex, subunit 3
  Uniprot ID: O75175
  ENSP ID: ENSP00000478913

SEQ ID NO: 12804 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000478956

SEQ ID NO: 12805 - protein, 571 aa, Homo sapiens; identical to SEQ ID NO: 12798
  Payload ID: 2500
  Gene Symbol: CNOT3
  Gene Name: CCR4-NOT transcription complex, subunit 3
  ENSP ID: ENSP00000479186

SEQ ID NO: 12806 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000479987

SEQ ID NO: 12807 - protein, 106 aa, Homo sapiens
  Payload ID: 2500
  Gene Symbol: CNOT3
  Gene Name: CCR4-NOT transcription complex, subunit 3
  ENSP ID: ENSP00000480220
  MOD_RES (1)..(1): Any amino acid
XLIETQMERFKVVERETKTKAYSKEGLGLAQKVDPAQKEKEEVGQWLTNTIDTLNMQVDQFESEVESLSVQTRKKKGDKDEGPSRCSAAPEPGPGLASRSRTGLRA

SEQ ID NO: 12808 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000480258

SEQ ID NO: 12809 - protein, 571 aa, Homo sapiens; identical to SEQ ID NO: 12798
  Payload ID: 2500
  Gene Symbol: CNOT3
  Gene Name: CCR4-NOT transcription complex, subunit 3
  ENSP ID: ENSP00000480392

SEQ ID NO: 12810 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000480585

SEQ ID NO: 12811 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000480697

SEQ ID NO: 12812 - protein, 96 aa, Homo sapiens
  Payload ID: 2500
  Gene Symbol: CNOT3
  Gene Name: CCR4-NOT transcription complex, subunit 3
  ENSP ID: ENSP00000480755
EFYQRLSTETLFFIFYYLEGTKAQYLAAKALKKQSWRFHTKYMMWFQRHEEPKTITDEFEQLAQSLSLTKYSSLWLSAQPGTPPSHPPLGQLLGLL

SEQ ID NO: 12813 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000480876

SEQ ID NO: 12814 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000480988

SEQ ID NO: 12815 - protein, 375 aa, Homo sapiens; identical to SEQ ID NO: 12794
  Payload ID: 2500
  Gene Symbol: CNOT3
  Gene Name: CCR4-NOT transcription complex, subunit 3
  ENSP ID: ENSP00000481527
  MOD_RES (1)..(1): Any amino acid

SEQ ID NO: 12816 - protein, 571 aa, Homo sapiens; identical to SEQ ID NO: 12798
  Payload ID: 2500
  Gene Symbol: CNOT3
  Gene Name: CCR4-NOT transcription complex, subunit 3
  ENSP ID: ENSP00000481624

SEQ ID NO: 12817 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000481681

SEQ ID NO: 12818 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000481924

SEQ ID NO: 12819 - protein, 93 aa, Homo sapiens
  Payload ID: 2500
  Gene Symbol: CNOT3
  Gene Name: CCR4-NOT transcription complex, subunit 3
  ENSP ID: ENSP00000482531
EFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 12820 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000483036

SEQ ID NO: 12821 - protein, 106 aa, Homo sapiens; identical to SEQ ID NO: 12807
  Payload ID: 2500
  Gene Symbol: CNOT3
  Gene Name: CCR4-NOT transcription complex, subunit 3
  ENSP ID: ENSP00000483360
  MOD_RES (1)..(1): Any amino acid

SEQ ID NO: 12822 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000483431

SEQ ID NO: 12823 - protein, 571 aa, Homo sapiens; identical to SEQ ID NO: 12798
  Payload ID: 2500
  Gene Symbol: CNOT3
  Gene Name: CCR4-NOT transcription complex, subunit 3
  ENSP ID: ENSP00000483450

SEQ ID NO: 12824 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000483604

SEQ ID NO: 12825 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000483692

SEQ ID NO: 12826 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000483882

SEQ ID NO: 12827 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000483968

SEQ ID NO: 12828 - protein, 88 aa, Homo sapiens; identical to SEQ ID NO: 12797
  Payload ID: 2500
  Gene Symbol: CNOT3
  Gene Name: CCR4-NOT transcription complex, subunit 3
  ENSP ID: ENSP00000484003

SEQ ID NO: 12829 - protein, 93 aa, Homo sapiens; identical to SEQ ID NO: 12819
  Payload ID: 2500
  Gene Symbol: CNOT3
  Gene Name: CCR4-NOT transcription complex, subunit 3
  ENSP ID: ENSP00000484020

SEQ ID NO: 12830 - protein, 753 aa, Homo sapiens; identical to SEQ ID NO: 12792
  Payload ID: 2500
  Gene Symbol: CNOT3
  Gene Name: CCR4-NOT transcription complex, subunit 3
  Uniprot ID: O75175
  ENSP ID: ENSP00000484040

SEQ ID NO: 12831 - protein, 571 aa, Homo sapiens; identical to SEQ ID NO: 12798
  Payload ID: 2500
  Gene Symbol: CNOT3
  Gene Name: CCR4-NOT transcription complex, subunit 3
  ENSP ID: ENSP00000484369

SEQ ID NO: 12832 - protein, 96 aa, Homo sapiens; identical to SEQ ID NO: 12812
  Payload ID: 2500
  Gene Symbol: CNOT3
  Gene Name: CCR4-NOT transcription complex, subunit 3
  ENSP ID: ENSP00000484612

SEQ ID NO: 12833 - protein, 753 aa, Homo sapiens; identical to SEQ ID NO: 12792
  Payload ID: 2500
  Gene Symbol: CNOT3
  Gene Name: CCR4-NOT transcription complex, subunit 3
  ENSP ID: ENSP00000484794

SEQ ID NO: 12834 - protein, 575 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000326731
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 12835 - protein, 175 aa, Homo sapiens
  Payload ID: 2501
  Gene Symbol: CNOT4
  Gene Name: CCR4-NOT transcription complex, subunit 4
  ENSP ID: ENSP00000348485
MAFPRNSIMHLNHTANPTSNSNFLDLNLPPQHNTGLGGIPVAGIPASSGNSLDSLQDDNPPHWLKSLQALTEMDGPALLHHRPTTAPLQHTDPAAQSQLESLPSSFKPFQLPLPTPRLSDSLQTPQQNPHRFTTEFNTGPPLGKEEQPLENAGFVPLCFLPLSPPPTAPFSSLMF

SEQ ID NO: 12836 - protein, 639 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000354673
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 12837 - protein, 710 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000388491
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVADNSSSVESLNMKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 12838 - protein, 572 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000399108
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQSPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGEEEVKVSTMPLSTSSHSLQQGQQPTSLHTTVA

SEQ ID NO: 12839 - protein, 642 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000406777
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVAGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 12840 - protein, 433 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000416532
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLTEPIERKRLAVLKRR

SEQ ID NO: 12841 - protein, 713 aa, Homo sapiens
  Payload ID: 2501
  Gene Symbol: CNOT4
  Gene Name: CCR4-NOT transcription complex, subunit 4
  Uniprot ID: O95628
  ENSP ID: ENSP00000445508
MSRSPDAKEDPVECPLCMEPLEIDDINFFPCTCGYQICRFCWHRIRTDENGLCPACRKPYPEDPAVYKPLSQEELQRIKNEKKQKQNERKQKISENRKHLASVRVVQKNLVFVVGLSQRLADPEVLKRPEYFGKFGKIHKVVINNSTSYAGSQGPSASAYVTYIRSEDALRAIQCVNNVVVDGRTLKASLGTTKYCSYFLKNMQCPKPDCMYLHELGDEAASFTKEEMQAGKHQEYEQKLLQELYKLNPNFLQLSTGSVDKNKNKVTPLQRYDTPIDKPSDSLSIGNGDNSQQISNSDTPSPPPGLSKSNPVIPISSSNHSARSPFEGAVTESQSLFSDNFRHPNPIPSGLPPFPSSPQTSSDWPTAPEPQSLFTSETIPVSSSTDWQAAFGFGSSKQPEDDLGFDPFDVTRKALADLIEKELSVQDQPSLSPTSLQNSSSHTTTAKGPGSGFLHPAAATNANSLNSTFSVLPQRFPQFQQHRAVYNSFSFPGQAARYPWMAFPRNSIMHLNHTANPTSNSNFLDLNLPPQHNTGLGGIPVADNSSSVESLNMKEWQDGLRALLPNININFGGLPNSSSPSNANHSAPTSNTATTDSLSWDSPGSWTDPAIITGIPASSGNSLDSLQDDNPPHWLKSLQALTEMDGPSAAPSQTHHSAPFSTQIPLHRASWNPYPPPSNPSSFHSPPPGFQTAFRPPSKTPTDLLQSSTLDRH

SEQ ID NO: 12842 - protein, 557 aa, Homo sapiens
  Payload ID: 2502
  Gene Symbol: CNOT6
  Gene Name: CCR4-NOT transcription complex, subunit 6
  Uniprot ID: Q9ULM6
  ENSP ID: ENSP00000261951
MPKEKYEPPDPRRMYTIMSSEEAANGKKSHWAELEISGKVRSLSASLWSLTHLTALHLSDNSLSRIPSDIAKLHNLVYLDLSSNKIRSLPAELGNMVSLRELHLNNNLLRVLPFELGKLFQLQTLGLKGNPLTQDILNLYQEPDGTRRLLNYLLDNLSGTAKRITTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAVLLELRKESIEMPSGKPHLGTEKQLILVANAHMHWDPEYSDVKLVQTMMFLSEVKNIIDKASRNLKSSVLGEFGTIPLVLCADLNSLPDSGVVEYLSTGGVETNHKDFKELRYNESLTNFSCHGKNGTTNGRITHGFKLQSAYESGLMPYTNYTFDFKGIIDYIFYSKPQLNTLGILGPLDHHWLVENNISGCPHPLIPSDHFSLFAQLELLLPFLPQVNGIHLPGRR

SEQ ID NO: 12843 - protein, 557 aa, Homo sapiens; identical to SEQ ID NO: 12842
  Payload ID: 2502
  Gene Symbol: CNOT6
  Gene Name: CCR4-NOT transcription complex, subunit 6
  Uniprot ID: Q9ULM6
  ENSP ID: ENSP00000377024

SEQ ID NO: 12844 - protein, 234 aa, Homo sapiens
  Payload ID: 2502
  Gene Symbol: CNOT6
  Gene Name: CCR4-NOT transcription complex, subunit 6
  ENSP ID: ENSP00000422087
MPKEKYEPPDPRRMYTIMSSEEAANGKKSHWAELEISGNPLTQDILNLYQEPDGTRRLLNYLLDNLSVTTEQPPPRSWIMLQEPDRTRPTALFSVMCYNVLCDKYATRQLYGYCPSWALNWDYRKKAIIQEILSCNADIVSLQEVETEQYYSFFLVELKERGYNGFFSPKSRARTMSEQERKHVDGCAIFFKTEKFTLVQKHTVEFNQLAMANSEGSEAMLNRVMTKDNIGVAV

SEQ ID NO: 12845 - protein, 557 aa, Homo sapiens; identical to SEQ ID NO: 12842
  Payload ID: 2502
  Gene Symbol: CNOT6
  Gene Name: CCR4-NOT transcription complex, subunit 6
  Uniprot ID: Q9ULM6
  ENSP ID: ENSP00000481893

SEQ ID NO: 12846 - protein, 469 aa, Homo sapiens
  Payload ID: 2503
  Gene Symbol: CNOT6L
  Gene Name: CCR4-NOT transcription complex, subunit 6-like
  ENSP ID: ENSP00000423750
  MOD_RES (1)..(1): Any amino acid
XCVCVSGVARGRDPRVACPSRFVAAAPEPRRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLAVHPEQLPPRPWITLKERDQILPSASFTVMCYNVLCDKYATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRA

SEQ ID NO: 12847 - protein, 555 aa, Homo sapiens
  Payload ID: 2503
  Gene Symbol: CNOT6L
  Gene Name: CCR4-NOT transcription complex, subunit 6-like
  Uniprot ID: Q96LI5
  ENSP ID: ENSP00000424896
MRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLAVHPEQLPPRPWITLKERDQILPSASFTVMCYNVLCDKYATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 12848 - protein, 562 aa, Homo sapiens
  Payload ID: 2503
  Gene Symbol: CNOT6L
  Gene Name: CCR4-NOT transcription complex, subunit 6-like
  ENSP ID: ENSP00000425571
PGPRRAECRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLAVHPEQLPPRPWITLKERDQILPSASFTVMCYNVLCDKYATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 12849 - protein, 46 aa, Homo sapiens
  Payload ID: 2503
  Gene Symbol: CNOT6L
  Gene Name: CCR4-NOT transcription complex, subunit 6-like
  ENSP ID: ENSP00000425836
MRLIGMPKEKYDPPDPRRIYTIMSAEEVANGKKSHWAELEISECGA

SEQ ID NO: 12850 - protein, 163 aa, Homo sapiens
  Payload ID: 2503
  Gene Symbol: CNOT6L
  Gene Name: CCR4-NOT transcription complex, subunit 6-like
  ENSP ID: ENSP00000426269
MRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLA

SEQ ID NO: 12851 - protein, 260 aa, Homo sapiens
  Payload ID: 2503
  Gene Symbol: CNOT6L
  Gene Name: CCR4-NOT transcription complex, subunit 6-like
  ENSP ID: ENSP00000426320
LKSCHCQVAAASNQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFK

SEQ ID NO: 12852 - protein, 285 aa, Homo sapiens
  Payload ID: 2504
  Gene Symbol: CNOT7
  Gene Name: CCR4-NOT transcription complex, subunit 7
  Uniprot ID: Q9UIV1
  ENSP ID: ENSP00000355279
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREMFFEDHIDDAKYCGHLYGLGSGSSYVQNGTGNAYEEEANKQS

SEQ ID NO: 12853 - protein, 208 aa, Homo sapiens
  Payload ID: 2504
  Gene Symbol: CNOT7
  Gene Name: CCR4-NOT transcription complex, subunit 7
  ENSP ID: ENSP00000428147
  MOD_RES (1)..(1): Any amino acid
XEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKVRLRMALSTAAHCSDQVTVMRA

SEQ ID NO: 12854 - protein, 62 aa, Homo sapiens
  Payload ID: 2504
  Gene Symbol: CNOT7
  Gene Name: CCR4-NOT transcription complex, subunit 7
  ENSP ID: ENSP00000428783
MPAATVDHSQRICEVWACNLDEEMKKIRQVIRKYNYVAMGFGVEKNLVSEKQLESTGRFPLF

SEQ ID NO: 12855 - protein, 40 aa, Homo sapiens
  Payload ID: 2504
  Gene Symbol: CNOT7
  Gene Name: CCR4-NOT transcription complex, subunit 7
  ENSP ID: ENSP00000429079
MPAATVDHSQRICEVWACNLDEEMKKIRQVIRKYNYVAMD

SEQ ID NO: 12856 - protein, 244 aa, Homo sapiens
  Payload ID: 2504
  Gene Symbol: CNOT7
  Gene Name: CCR4-NOT transcription complex, subunit 7
  Uniprot ID: Q9UIV1
  ENSP ID: ENSP00000429093
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVLCEGVKWLSFHSGYDFGYLIKILTNSNLPEEELDFFEILRLFFPVIYDVKYLMKSCKNLKGGLQEVAEQLELERIGPQHQAGSDSLLTGMAFFKMREV

SEQ ID NO: 12857 - protein, 51 aa, Homo sapiens
  Payload ID: 2504
  Gene Symbol: CNOT7
  Gene Name: CCR4-NOT transcription complex, subunit 7
  ENSP ID: ENSP00000429632
MPAATVDHSQRICEVWACNLDEEMKKIRQVIRKYNYVAMFFKKLGFSIGIL

SEQ ID NO: 12858 - protein, 147 aa, Homo sapiens
  Payload ID: 2504
  Gene Symbol: CNOT7
  Gene Name: CCR4-NOT transcription complex, subunit 7
  ENSP ID: ENSP00000430160
MPAATVDHSQRICEVWACNLDEEMKKIRQVIRKYNYVAMDTEFPGVVARPIGEFRSNADYQYQLLRCNVDLLKIIQLGLTFMNEQGEYPPGTSTWQFNFKFNLTEDMYAQDSIELLTTSGIQFKKHEEEGIETQYFAELLMTSGVVL

SEQ ID NO: 12859 - protein, 91 aa, Homo sapiens
  Payload ID: 2504
  Gene Symbol: CNOT7
  Gene Name: CCR4-NOT transcription complex, subunit 7
  ENSP ID: ENSP00000430263
  MOD_RES (1)..(1): Any amino acid
XGYDFGYLIKILTNSNLPEEELDFFEILRLFFPVIYDVKYLMKSCKNLKMFFEDHIDDAKYCGHLYGLGSGSSYVQNGTGNAYEEEANKQS

SEQ ID NO: 12860 - protein, 51 aa, Homo sapiens; identical to SEQ ID NO: 12857
  Payload ID: 2504
  Gene Symbol: CNOT7
  Gene Name: CCR4-NOT transcription complex, subunit 7
  ENSP ID: ENSP00000487113

SEQ ID NO: 12861 - protein, 292 aa, Homo sapiens
  Payload ID: 2505
  Gene Symbol: CNOT8
  Gene Name: CCR4-NOT transcription complex, subunit 8
  Uniprot ID: Q9UFF9
  ENSP ID: ENSP00000285896
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 12862 - protein, 292 aa, Homo sapiens; identical to SEQ ID NO: 12861
  Payload ID: 2505
  Gene Symbol: CNOT8
  Gene Name: CCR4-NOT transcription complex, subunit 8
  Uniprot ID: Q9UFF9
  ENSP ID: ENSP00000384747

SEQ ID NO: 12863 - protein, 118 aa, Homo sapiens
  Payload ID: 2505
  Gene Symbol: CNOT8
  Gene Name: CCR4-NOT transcription complex, subunit 8
  ENSP ID: ENSP00000428090
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLAN

SEQ ID NO: 12864 - protein, 186 aa, Homo sapiens
  Payload ID: 2505
  Gene Symbol: CNOT8
  Gene Name: CCR4-NOT transcription complex, subunit 8
  Uniprot ID: Q9UFF9
  ENSP ID: ENSP00000428305
MYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 12865 - protein, 85 aa, Homo sapiens
  Payload ID: 2505
  Gene Symbol: CNOT8
  Gene Name: CCR4-NOT transcription complex, subunit 8
  ENSP ID: ENSP00000428359
MYSQDSIDLLANSGLQFQKHEEEGIDTLHFAELLMTSGVVLCDNVKWLSFHSGYDFGYMVKLLTDSRLPEEEHEFFHILNLFFPS

SEQ ID NO: 12866 - protein, 121 aa, Homo sapiens
  Payload ID: 2505
  Gene Symbol: CNOT8
  Gene Name: CCR4-NOT transcription complex, subunit 8
  ENSP ID: ENSP00000428550
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLP

SEQ ID NO: 12867 - protein, 186 aa, Homo sapiens; identical to SEQ ID NO: 12864
  Payload ID: 2505
  Gene Symbol: CNOT8
  Gene Name: CCR4-NOT transcription complex, subunit 8
  Uniprot ID: Q9UFF9
  ENSP ID: ENSP00000428565

SEQ ID NO: 12868 - protein, 117 aa, Homo sapiens
  Payload ID: 2505
  Gene Symbol: CNOT8
  Gene Name: CCR4-NOT transcription complex, subunit 8
  ENSP ID: ENSP00000428576
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTYKKEKVNNNTCVA

SEQ ID NO: 12869 - protein, 52 aa, Homo sapiens
  Payload ID: 2505
  Gene Symbol: CNOT8
  Gene Name: CCR4-NOT transcription complex, subunit 8
  ENSP ID: ENSP00000428600
MPAALVENSQVICEVWASNLEEEMRKIREIVLSYSYIAMRGHVLPGFHRSPC

SEQ ID NO: 12870 - protein, 90 aa, Homo sapiens
  Payload ID: 2505
  Gene Symbol: CNOT8
  Gene Name: CCR4-NOT transcription complex, subunit 8
  ENSP ID: ENSP00000428842
MPAALVENSQVICEVWASNLEEEMRKIREIVLSYSYIAMDTEFPGVVVRPIGEFRSSIDYQYQLLRCNVDLLKIIQLGLTFTNEKGEYPS

SEQ ID NO: 12871 - protein, 118 aa, Homo sapiens; identical to SEQ ID NO: 12863
  Payload ID: 2505
  Gene Symbol: CNOT8
  Gene Name: CCR4-NOT transcription complex, subunit 8
  ENSP ID: ENSP00000429108

SEQ ID NO: 12872 - protein, 55 aa, Homo sapiens
  Payload ID: 2505
  Gene Symbol: CNOT8
  Gene Name: CCR4-NOT transcription complex, subunit 8
  ENSP ID: ENSP00000429310
MPAALVENSQVICEVWASNLEEEMRKIREIVLSYSYIAMDTEFPGVVVRPIGEFR

SEQ ID NO: 12873 - protein, 225 aa, Homo sapiens
  Payload ID: 2505
  Gene Symbol: CNOT8
  Gene Name: CCR4-NOT transcription complex, subunit 8
  ENSP ID: ENSP00000429394
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQE

SEQ ID NO: 12874 - protein, 128 aa, Homo sapiens
  Payload ID: 2505
  Gene Symbol: CNOT8
  Gene Name: CCR4-NOT transcription complex, subunit 8
  ENSP ID: ENSP00000429576
MVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 12875 - protein, 55 aa, Homo sapiens; identical to SEQ ID NO: 12872
  Payload ID: 2505
  Gene Symbol: CNOT8
  Gene Name: CCR4-NOT transcription complex, subunit 8
  ENSP ID: ENSP00000429810

SEQ ID NO: 12876 - protein, 186 aa, Homo sapiens; identical to SEQ ID NO: 12864
  Payload ID: 2505
  Gene Symbol: CNOT8
  Gene Name: CCR4-NOT transcription complex, subunit 8
  Uniprot ID: Q9UFF9
  ENSP ID: ENSP00000429882

SEQ ID NO: 12877 - protein, 132 aa, Homo sapiens
  Payload ID: 2505
  Gene Symbol: CNOT8
  Gene Name: CCR4-NOT transcription complex, subunit 8
  ENSP ID: ENSP00000430215
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGID

SEQ ID NO: 12878 - protein, 292 aa, Homo sapiens; identical to SEQ ID NO: 12861
  Payload ID: 2505
  Gene Symbol: CNOT8
  Gene Name: CCR4-NOT transcription complex, subunit 8
  Uniprot ID: Q9UFF9
  ENSP ID: ENSP00000430493

SEQ ID NO: 12879 - protein, 238 aa, Homo sapiens
  Payload ID: 2505
  Gene Symbol: CNOT8
  Gene Name: CCR4-NOT transcription complex, subunit 8
  Uniprot ID: Q9UFF9
  ENSP ID: ENSP00000430833
MPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 12880 - protein, 186 aa, Homo sapiens; identical to SEQ ID NO: 12864
  Payload ID: 2505
  Gene Symbol: CNOT8
  Gene Name: CCR4-NOT transcription complex, subunit 8
  Uniprot ID: Q9UFF9
  ENSP ID: ENSP00000431034

SEQ ID NO: 12881 - protein, 482 aa, Homo sapiens
  Payload ID: 2506
  Gene Symbol: CCZ1B
  Gene Name: CCZ1 homolog B, vacuolar protein trafficking and biogenesis associated
  Uniprot ID: P86790
  ENSP ID: ENSP00000314544
MAAAAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 12882 - protein, 78 aa, Homo sapiens
  Payload ID: 2506
  Gene Symbol: CCZ1B
  Gene Name: CCZ1 homolog B, vacuolar protein trafficking and biogenesis associated
  ENSP ID: ENSP00000390078
MAAAAAGAGSGPWAAQEKQFPPALLSFFIYNPRFGPREGQEENKILFYHPNEVEKNEKIRNVGLCEAIVQFTRLFGIL

SEQ ID NO: 12883 - protein, 78 aa, Homo sapiens; identical to SEQ ID NO: 12882
  Payload ID: 2506
  Gene Symbol: CCZ1B
  Gene Name: CCZ1 homolog B, vacuolar protein trafficking and biogenesis associated
  ENSP ID: ENSP00000487253

SEQ ID NO: 12884 - protein, 482 aa, Homo sapiens; identical to SEQ ID NO: 12881
  Payload ID: 2507
  Gene Symbol: CCZ1
  Gene Name: CCZ1 homolog, vacuolar protein trafficking and biogenesis associated
  Uniprot ID: P86791
  ENSP ID: ENSP00000325681

SEQ ID NO: 12885 - protein, 78 aa, Homo sapiens; identical to SEQ ID NO: 12882
  Payload ID: 2507
  Gene Symbol: CCZ1
  Gene Name: CCZ1 homolog, vacuolar protein trafficking and biogenesis associated
  ENSP ID: ENSP00000486988

SEQ ID NO: 12886 - protein, 1021 aa, Homo sapiens
  Payload ID: 2508
  Gene Symbol: CD101
  Gene Name: CD101 molecule
  Uniprot ID: Q93033
  ENSP ID: ENSP00000256652
MAGISYVASFFLLLTKLSIGQREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVMSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 12887 - protein, 1021 aa, Homo sapiens; identical to SEQ ID NO: 12886
  Payload ID: 2508
  Gene Symbol: CD101
  Gene Name: CD101 molecule
  Uniprot ID: Q93033
  ENSP ID: ENSP00000358482

SEQ ID NO: 12888 - protein, 1445 aa, Homo sapiens
  Payload ID: 2509
  Gene Symbol: CD109
  Gene Name: CD109 molecule
  Uniprot ID: Q6YHK3
  ENSP ID: ENSP00000287097
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 12889 - protein, 1428 aa, Homo sapiens
  Payload ID: 2509
  Gene Symbol: CD109
  Gene Name: CD109 molecule
  Uniprot ID: Q6YHK3
  ENSP ID: ENSP00000388062
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPLAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 12890 - protein, 1368 aa, Homo sapiens
  Payload ID: 2509
  Gene Symbol: CD109
  Gene Name: CD109 molecule
  Uniprot ID: Q6YHK3
  ENSP ID: ENSP00000404475
MQGPPLLTAAHLLCVCTAALAVAPGPRFLVTAPGIIRPGGNVTIGVELLEHCPSQVTVKAELLKTASNLTVSVLEAEGVFEKGSFKTLTLPSDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 12891 - protein, 375 aa, Homo sapiens
  Payload ID: 2510
  Gene Symbol: CD14
  Gene Name: CD14 molecule
  Uniprot ID: P08571
  ENSP ID: ENSP00000304236
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 12892 - protein, 375 aa, Homo sapiens; identical to SEQ ID NO: 12891
  Payload ID: 2510
  Gene Symbol: CD14
  Gene Name: CD14 molecule
  Uniprot ID: P08571
  ENSP ID: ENSP00000385519

SEQ ID NO: 12893 - protein, 55 aa, Homo sapiens
  Payload ID: 2510
  Gene Symbol: CD14
  Gene Name: CD14 molecule
  ENSP ID: ENSP00000425447
MERASCLLLLLLPLVHVSATTPEPCELDDEDFRCVCNFSEPQPDWSEAFQCVSAV

SEQ ID NO: 12894 - protein, 213 aa, Homo sapiens
  Payload ID: 2510
  Gene Symbol: CD14
  Gene Name: CD14 molecule
  ENSP ID: ENSP00000426543
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLM

SEQ ID NO: 12895 - protein, 81 aa, Homo sapiens
  Payload ID: 2510
  Gene Symbol: CD14
  Gene Name: CD14 molecule
  ENSP ID: ENSP00000430884
MERASCLLLLLLPLVHVSATTPEPCELDDEDFRCVCNFSEPQPDWSEAFQCVSAVEVEIHAGGLNLEPFLKRVDADADPRQ

SEQ ID NO: 12896 - protein, 253 aa, Homo sapiens
  Payload ID: 2511
  Gene Symbol: CD151
  Gene Name: CD151 molecule (Raph blood group)
  Uniprot ID: P48509
  ENSP ID: ENSP00000324101
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 12897 - protein, 253 aa, Homo sapiens; identical to SEQ ID NO: 12896
  Payload ID: 2511
  Gene Symbol: CD151
  Gene Name: CD151 molecule (Raph blood group)
  Uniprot ID: P48509
  ENSP ID: ENSP00000380565

SEQ ID NO: 12898 - protein, 253 aa, Homo sapiens; identical to SEQ ID NO: 12896
  Payload ID: 2511
  Gene Symbol: CD151
  Gene Name: CD151 molecule (Raph blood group)
  Uniprot ID: P48509
  ENSP ID: ENSP00000380566

SEQ ID NO: 12899 - protein, 180 aa, Homo sapiens
  Payload ID: 2511
  Gene Symbol: CD151
  Gene Name: CD151 molecule (Raph blood group)
  ENSP ID: ENSP00000431403
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVV

SEQ ID NO: 12900 - protein, 79 aa, Homo sapiens
  Payload ID: 2511
  Gene Symbol: CD151
  Gene Name: CD151 molecule (Raph blood group)
  ENSP ID: ENSP00000431671
MGEFNEKKTTCGTVCLKYLLFTYNCCFWLAGLAVMAVGIWTLALKSDYISLLASGTYLATAYILVVAGTVVMVTGVLGC

SEQ ID NO: 12901 - protein, 178 aa, Homo sapiens
  Payload ID: 2511
  Gene Symbol: CD151
  Gene Name: CD151 molecule (Raph blood group)
  ENSP ID: ENSP00000432258
MGEFNEKKTTCGTVCLKYLLFTYNCCFWLAGLAVMAVGIWTLALKSDYISLLASGTYLATAYILVVAGTVVMVTGVLGCCATFKERRNLLRLLNTELKENLKDTMTKRYHQPGHEAVTSAVDQLQQEFHCCGSNNSQDWRDSEWIRSQEAGGRVVPDSCCKTVVALCGQRDHASNIYK

SEQ ID NO: 12902 - protein, 253 aa, Homo sapiens; identical to SEQ ID NO: 12896
  Payload ID: 2511
  Gene Symbol: CD151
  Gene Name: CD151 molecule (Raph blood group)
  Uniprot ID: P48509
  ENSP ID: ENSP00000432385

SEQ ID NO: 12903 - protein, 251 aa, Homo sapiens
  Payload ID: 2511
  Gene Symbol: CD151
  Gene Name: CD151 molecule (Raph blood group)
  ENSP ID: ENSP00000432990
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKGGCITKLETFIQEHLRVIGAVGIGIACVQVFGMIFTCCLYRSLKLEHY

SEQ ID NO: 12904 - protein, 90 aa, Homo sapiens
  Payload ID: 2511
  Gene Symbol: CD151
  Gene Name: CD151 molecule (Raph blood group)
  ENSP ID: ENSP00000433752
MGEFNEKKTTCGTVCLKYLLFTYNCCFWLAGLAVMAVGIWTLALKSDYISLLASGTYLATAYILVVAGTVVMVTGVLGCCATFKERRNLL

SEQ ID NO: 12905 - protein, 170 aa, Homo sapiens
  Payload ID: 2511
  Gene Symbol: CD151
  Gene Name: CD151 molecule (Raph blood group)
  ENSP ID: ENSP00000433787
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWI

SEQ ID NO: 12906 - protein, 64 aa, Homo sapiens
  Payload ID: 2511
  Gene Symbol: CD151
  Gene Name: CD151 molecule (Raph blood group)
  ENSP ID: ENSP00000434663
MGEFNEKKTTCGTVCLKYLLFTYNCCFWLAGLAVMAVGIWTLALKSDYISLLASGTYLATAYIL

SEQ ID NO: 12907 - protein, 176 aa, Homo sapiens
  Payload ID: 2511
  Gene Symbol: CD151
  Gene Name: CD151 molecule (Raph blood group)
  ENSP ID: ENSP00000435054
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAG

SEQ ID NO: 12908 - protein, 92 aa, Homo sapiens
  Payload ID: 2511
  Gene Symbol: CD151
  Gene Name: CD151 molecule (Raph blood group)
  ENSP ID: ENSP00000435854
MGEFNEKKTTCGTVCLKYLLFTYNCCFWLAGLAVMAVGIWTLALKSDYISLLASGTYLATAYILVVAGTVVMVTGVLGCCATFKERRNLLRL

SEQ ID NO: 12909 - protein, 180 aa, Homo sapiens; identical to SEQ ID NO: 12899
  Payload ID: 2511
  Gene Symbol: CD151
  Gene Name: CD151 molecule (Raph blood group)
  ENSP ID: ENSP00000436591

SEQ ID NO: 12910 - protein, 181 aa, Homo sapiens
  Payload ID: 2512
  Gene Symbol: CD160
  Gene Name: CD160 molecule
  Uniprot ID: O95971
  ENSP ID: ENSP00000235933
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 12911 - protein, 181 aa, Homo sapiens; identical to SEQ ID NO: 12910
  Payload ID: 2512
  Gene Symbol: CD160
  Gene Name: CD160 molecule
  Uniprot ID: O95971
  ENSP ID: ENSP00000358294

SEQ ID NO: 12912 - protein, 234 aa, Homo sapiens
  Payload ID: 2512
  Gene Symbol: CD160
  Gene Name: CD160 molecule
  ENSP ID: ENSP00000385199
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQGMSKRAVSTPSNEGAIIFLPPWLFSRRRRLERMSRGREKCYSSPGYPQESSNQFH

SEQ ID NO: 12913 - protein, 72 aa, Homo sapiens
  Payload ID: 2512
  Gene Symbol: CD160
  Gene Name: CD160 molecule
  ENSP ID: ENSP00000462594
MLLEPGRGCCALAILLAIVDIQSGETGNYTVTGLKQRQHLEFSHNEGTLSSGFLQEKVWVMLVTSLVALQAL

SEQ ID NO: 12914 - protein, 125 aa, Homo sapiens
  Payload ID: 2512
  Gene Symbol: CD160
  Gene Name: CD160 molecule
  ENSP ID: ENSP00000483935
MLLEPGRGCCALAILLAIVDIQSGETGNYTVTGLKQRQHLEFSHNEGTLSSGFLQEKVWVMLVTSLVALQGMSKRAVSTPSNEGAIIFLPPWLFSRRRRLERMSRGREKCYSSPGYPQESSNQFH

SEQ ID NO: 12915 - protein, 1156 aa, Homo sapiens
  Payload ID: 2513
  Gene Symbol: CD163
  Gene Name: CD163 molecule
  Uniprot ID: Q86VB7
  ENSP ID: ENSP00000352071
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 12916 - protein, 1154 aa, Homo sapiens
  Payload ID: 2513
  Gene Symbol: CD163
  Gene Name: CD163 molecule
  ENSP ID: ENSP00000379863
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSSKTQKTSLIGSHTVKGTGLGSHSCLFLKPCLLPGYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 12917 - protein, 1121 aa, Homo sapiens
  Payload ID: 2513
  Gene Symbol: CD163
  Gene Name: CD163 molecule
  Uniprot ID: Q86VB7
  ENSP ID: ENSP00000403885
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 12918 - protein, 137 aa, Homo sapiens
  Payload ID: 2513
  Gene Symbol: CD163
  Gene Name: CD163 molecule
  ENSP ID: ENSP00000439226
  MOD_RES (1)..(1): Any amino acid
XGPIWLNEVKCKGNESSLWDCPARRWGHSECGHKEDAAVNCTDISVQKTPQKATTGRSSRQSSFIAVGILGVVLLAIFVALFFLTKKRRQRQRLAENSHESADFSAAELISVSKFLPISGMEKEAILSHTEKENGNL

SEQ ID NO: 12919 - protein, 1109 aa, Homo sapiens
  Payload ID: 2513
  Gene Symbol: CD163
  Gene Name: CD163 molecule
  ENSP ID: ENSP00000444071
MSLDFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 12920 - protein, 124 aa, Homo sapiens
  Payload ID: 2513
  Gene Symbol: CD163
  Gene Name: CD163 molecule
  ENSP ID: ENSP00000445438
DDAQVVCQQLGCGPALKAFKEAEFGQGTGPIWLNEVKCKGNESSLWDCPARRWGHSECGHKEDAAVNCTDISVQKTPQKATTENSHESADFSAAELISVSKFLPISGMEKEAILSHTEKENGNL

SEQ ID NO: 12921 - protein, 1453 aa, Homo sapiens
  Payload ID: 2514
  Gene Symbol: CD163L1
  Gene Name: CD163 molecule-like 1
  Uniprot ID: Q9NR16
  ENSP ID: ENSP00000315945
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPLHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 12922 - protein, 1463 aa, Homo sapiens
  Payload ID: 2514
  Gene Symbol: CD163L1
  Gene Name: CD163 molecule-like 1
  Uniprot ID: Q9NR16
  ENSP ID: ENSP00000393474
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGKSLTRVGRQGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPLHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 12923 - protein, 109 aa, Homo sapiens
  Payload ID: 2514
  Gene Symbol: CD163L1
  Gene Name: CD163 molecule-like 1
  ENSP ID: ENSP00000438217
  MOD_RES (1)..(1): Any amino acid
XSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 12924 - protein, 189 aa, Homo sapiens
  Payload ID: 2514
  Gene Symbol: CD163L1
  Gene Name: CD163 molecule-like 1
  ENSP ID: ENSP00000439921
TFLCDFILDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSGDATWGLRLVGGSNRCSGRLEVYFQGRWGTVCDDGWNSKAAAVVCSQLDCPSSIIGMGLGNASTGYGKIWLDDV

SEQ ID NO: 12925 - protein, 61 aa, Homo sapiens
  Payload ID: 2514
  Gene Symbol: CD163L1
  Gene Name: CD163 molecule-like 1
  ENSP ID: ENSP00000442328
MFRFGQAVTRHGKIWLDDVSCYGNESALWECQHREWGSHNCYHGEDVGVNCYGEANLGLRL

SEQ ID NO: 12926 - protein, 58 aa, Homo sapiens
  Payload ID: 2514
  Gene Symbol: CD163L1
  Gene Name: CD163 molecule-like 1
  ENSP ID: ENSP00000443004
  MOD_RES (1)..(1): Any amino acid
XSGQSLKSLNASSGHLALILSSIFGLLLLVLFILFLTWCRVQKQKHLPLRGESPTRIV

SEQ ID NO: 12927 - protein, 184 aa, Homo sapiens
  Payload ID: 2515
  Gene Symbol: CD164
  Gene Name: CD164 molecule, sialomucin
  Uniprot ID: Q04900
  ENSP ID: ENSP00000275080
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSAKPTVQPSPSTTSKTVTTSGTTNNTVTPTSQPVRKSTFDAASFIGGIVLVLGVQAVIFFLYKFCKSKERNYHTL

SEQ ID NO: 12928 - protein, 197 aa, Homo sapiens
  Payload ID: 2515
  Gene Symbol: CD164
  Gene Name: CD164 molecule, sialomucin
  Uniprot ID: Q04900
  ENSP ID: ENSP00000309376
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 12929 - protein, 178 aa, Homo sapiens
  Payload ID: 2515
  Gene Symbol: CD164
  Gene Name: CD164 molecule, sialomucin
  Uniprot ID: Q04900
  ENSP ID: ENSP00000314177
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTGTTNNTVTPTSQPVRKSTFDAASFIGGIVLVLGVQAVIFFLYKFCKSKERNYHTL

SEQ ID NO: 12930 - protein, 147 aa, Homo sapiens
  Payload ID: 2515
  Gene Symbol: CD164
  Gene Name: CD164 molecule, sialomucin
  ENSP ID: ENSP00000357957
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTAQCQQPILQLNPQFSPPLLQLPRQLLHQVQQITL

SEQ ID NO: 12931 - protein, 189 aa, Homo sapiens
  Payload ID: 2515
  Gene Symbol: CD164
  Gene Name: CD164 molecule, sialomucin
  Uniprot ID: Q04900
  ENSP ID: ENSP00000402237
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLEIRCHTRNYIPDLKK

SEQ ID NO: 12932 - protein, 163 aa, Homo sapiens
  Payload ID: 2515
  Gene Symbol: CD164
  Gene Name: CD164 molecule, sialomucin
  ENSP ID: ENSP00000422999
MRKGRKVPMYVPGVLRTYPKAKLEETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 12933 - protein, 157 aa, Homo sapiens
  Payload ID: 2515
  Gene Symbol: CD164
  Gene Name: CD164 molecule, sialomucin
  Uniprot ID: Q04900
  ENSP ID: ENSP00000427546
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSEIRCHTRNYIPDLKK

SEQ ID NO: 12934 - protein, 173 aa, Homo sapiens
  Payload ID: 2516
  Gene Symbol: CD164L2
  Gene Name: CD164 sialomucin-like 2
  Uniprot ID: Q6UWJ8
  ENSP ID: ENSP00000363139
MEAPGPRALRTALCGGCCCLLLCAQLAVAGKGARGFGRGALIRLNIWPAVQGACKQLEVCEHCVEGDGARNLSSCVWEQCRPEEPGHCVAQSEVVKEGCSIYNRSEACPAAHHHPTYEPKTVTTGSPPVPEAHSPGFDGASFIGGVVLVLSLQAVAFFVLHFLKAKDSTYQTL

SEQ ID NO: 12935 - protein, 174 aa, Homo sapiens
  Payload ID: 2516
  Gene Symbol: CD164L2
  Gene Name: CD164 sialomucin-like 2
  Uniprot ID: Q6UWJ8
  ENSP ID: ENSP00000363142
MEAPGPRALRTALCGGCCCLLLCAQLAVAGKGARGFGRGALIRLNIWPAVQGACKQLEVCEHCVEGDGARNLSSCVWEQCRPEEPGHCVAQSEVVKEGCSIYNRSEACPAAHHHPTYEPKTVTTGSPPVPEAHSPGFDGASFIGGVVLVLSLQAVAFFVLHFLKAKDSTYQTLI

SEQ ID NO: 12936 - protein, 145 aa, Homo sapiens
  Payload ID: 2517
  Gene Symbol: CD177
  Gene Name: CD177 molecule
  Uniprot ID: Q8N6Q3
  ENSP ID: ENSP00000367251
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPMMGAAEGPFGKAEQVDS

SEQ ID NO: 12937 - protein, 437 aa, Homo sapiens
  Payload ID: 2517
  Gene Symbol: CD177
  Gene Name: CD177 molecule
  ENSP ID: ENSP00000479536
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPVCNLLNGTQEIGPVGMTENCDMKDFLTCHRGTTIMTHGNLAQEPTDWTTSNTEMCEVGQVCQETLLLLDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 12938 - protein, 139 aa, Homo sapiens
  Payload ID: 2517
  Gene Symbol: CD177
  Gene Name: CD177 molecule
  ENSP ID: ENSP00000483817
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPAGACGRVGRRGRGC

SEQ ID NO: 12939 - protein, 661 aa, Homo sapiens
  Payload ID: 2518
  Gene Symbol: CD180
  Gene Name: CD180 molecule
  Uniprot ID: Q99467
  ENSP ID: ENSP00000256447
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTIFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 12940 - protein, 556 aa, Homo sapiens [sequence omitted]

SEQ ID NO: 12941 - protein, 557 aa, Homo sapiens
  Payload ID: 2519
  Gene Symbol: CD19
  Gene Name: CD19 molecule
  Uniprot ID: P15391
  ENSP ID: ENSP00000437940
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 12942 - protein, 557 aa, Homo sapiens; identical to SEQ ID NO: 12941
  Payload ID: 2519
  Gene Symbol: CD19
  Gene Name: CD19 molecule
  Uniprot ID: P15391
  ENSP ID: ENSP00000456201

SEQ ID NO: 12943 - protein, 467 aa, Homo sapiens
  Payload ID: 2519
  Gene Symbol: CD19
  Gene Name: CD19 molecule
  ENSP ID: ENSP00000481090
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSRREWAQKKRKGRAMRNLTVRRTPSSMRTTPTLGRTSSPRMAAATRTLRMSPWVLRMKTPSPTLSLMRTRMKS

SEQ ID NO: 12944 - protein, 327 aa, Homo sapiens
  Payload ID: 2520
  Gene Symbol: CD1A
  Gene Name: CD1a molecule
  Uniprot ID: P06126
  ENSP ID: ENSP00000289429
MLFLLLPLLAVLPGDGNADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 12945 - protein, 333 aa, Homo sapiens
  Payload ID: 2521
  Gene Symbol: CD1B
  Gene Name: CD1b molecule
  Uniprot ID: P29016
  ENSP ID: ENSP00000357150
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 12946 - protein, 246 aa, Homo sapiens
  Payload ID: 2521
  Gene Symbol: CD1B
  Gene Name: CD1b molecule
  ENSP ID: ENSP00000395161
  MOD_RES (1)..(1): Any amino acid
XSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGNPTSIGSIVLAIIVPSLLLLLCLALWYMRRRSYQNIP

SEQ ID NO: 12947 - protein, 333 aa, Homo sapiens
  Payload ID: 2522
  Gene Symbol: CD1C
  Gene Name: CD1c molecule
  Uniprot ID: P29017
  ENSP ID: ENSP00000357152
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 12948 - protein, 281 aa, Homo sapiens
  Payload ID: 2522
  Gene Symbol: CD1C
  Gene Name: CD1c molecule
  ENSP ID: ENSP00000408755
  MOD_RES (1)..(1): Any amino acid
XFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWAHIRTSCETLPPDSPIVLRTQQPRSLVQYSDAIPSTLHLNCFSFCIINIC

SEQ ID NO: 12949 - protein, 335 aa, Homo sapiens
  Payload ID: 2523
  Gene Symbol: CD1D
  Gene Name: CD1d molecule
  Uniprot ID: P15813
  ENSP ID: ENSP00000357153
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 12950 - protein, 144 aa, Homo sapiens
  Payload ID: 2524
  Gene Symbol: CD1E
  Gene Name: CD1e molecule
  Uniprot ID: P15812
  ENSP ID: ENSP00000357136
MLLLFLLFEGLCCPGENTAVKPEAWLSCGPSPGPGRLQLVCHVSGFYPKPVWVMWMRGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 12951 - protein, 231 aa, Homo sapiens
  Payload ID: 2524
  Gene Symbol: CD1E
  Gene Name: CD1e molecule
  Uniprot ID: P15812
  ENSP ID: ENSP00000357137
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 12952 - protein, 286 aa, Homo sapiens
  Payload ID: 2524
  Gene Symbol: CD1E
  Gene Name: CD1e molecule
  Uniprot ID: P15812
  ENSP ID: ENSP00000357138
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 12953 - protein, 132 aa, Homo sapiens
  Payload ID: 2524
  Gene Symbol: CD1E
  Gene Name: CD1e molecule
  Uniprot ID: P15812
  ENSP ID: ENSP00000357139
MLLLFLLFEGLCCPGENTAVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 12954 - protein, 376 aa, Homo sapiens
  Payload ID: 2524
  Gene Symbol: CD1E
  Gene Name: CD1e molecule
  Uniprot ID: P15812
  ENSP ID: ENSP00000357142
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 12955 - protein, 290 aa, Homo sapiens
  Payload ID: 2524
  Gene Symbol: CD1E
  Gene Name: CD1e molecule
  Uniprot ID: P15812
  ENSP ID: ENSP00000357143
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 12956 - protein, 60 aa, Homo sapiens
  Payload ID: 2524
  Gene Symbol: CD1E
  Gene Name: CD1e molecule
  ENSP ID: ENSP00000357144
  MOD_RES (1)..(1): Any amino acid
XVSGFYPKPVWVMWMRGEQEQRGTQRGDVLPNADETWWIFHLSHPDLFDCDSYPGHIGCS

SEQ ID NO: 12957 - protein, 321 aa, Homo sapiens
  Payload ID: 2524
  Gene Symbol: CD1E
  Gene Name: CD1e molecule
  Uniprot ID: P15812
  ENSP ID: ENSP00000357145
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGGYSIFLILICLTVIVTLVILVVVDSRLKKQSPVFLMGANTQDTKNSRHQFCLAQVSWIKNRVLKKWKTRLNQLW

SEQ ID NO: 12958 - protein, 101 aa, Homo sapiens
  Payload ID: 2524
  Gene Symbol: CD1E
  Gene Name: CD1e molecule
  Uniprot ID: P15812
  ENSP ID: ENSP00000357146
MLLLFLLFEGLCCPGENTAVKPEAWLSCGPSPGPGRLQLVCHVSGFYPKPVWVMWMRGEQEQRGTQRGDVLPNADETWWIFHLSHPDLFDCDSYPGHIGCS

SEQ ID NO: 12959 - protein, 298 aa, Homo sapiens
  Payload ID: 2524
  Gene Symbol: CD1E
  Gene Name: CD1e molecule
  Uniprot ID: P15812
  ENSP ID: ENSP00000357147
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLELKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 12960 - protein, 187 aa, Homo sapiens
  Payload ID: 2524
  Gene Symbol: CD1E
  Gene Name: CD1e molecule
  Uniprot ID: P15812
  ENSP ID: ENSP00000357148
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSPVFLMGANTQDTKNSRHQFCLAQVSWIKNRVLKKWKTRLNQLW

SEQ ID NO: 12961 - protein, 388 aa, Homo sapiens
  Payload ID: 2524
  Gene Symbol: CD1E
  Gene Name: CD1e molecule
  Uniprot ID: P15812
  ENSP ID: ENSP00000357149
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 12962 - protein, 289 aa, Homo sapiens
  Payload ID: 2524
  Gene Symbol: CD1E
  Gene Name: CD1e molecule
  Uniprot ID: P15812
  ENSP ID: ENSP00000402906
MLLLFLLFEGLCCPGENTADPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 12963 - protein, 199 aa, Homo sapiens
  Payload ID: 2524
  Gene Symbol: CD1E
  Gene Name: CD1e molecule
  Uniprot ID: P15812
  ENSP ID: ENSP00000416228
MLLLFLLFEGLCCPGENTAVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 12964 - protein, 341 aa, Homo sapiens
  Payload ID: 2525
  Gene Symbol: CD2BP2
  Gene Name: CD2 (cytoplasmic tail) binding protein 2
  Uniprot ID: O95400
  ENSP ID: ENSP00000304903
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRLDRLSGLADQMVARGNLGVYQETRERLAMRLKGLGCQTLGPHNPTPPPSLDMFAEELAEEELETPTPTQRGEAESRGDGLVDVMWEYKWENTGDAELYGPFTSAQMQTWVSEGYFPDGVYCRKLDPPGGQFYNSKRIDFDLYT

SEQ ID NO: 12965 - protein, 341 aa, Homo sapiens; identical to SEQ ID NO: 12964
  Payload ID: 2525
  Gene Symbol: CD2BP2
  Gene Name: CD2 (cytoplasmic tail) binding protein 2
  Uniprot ID: O95400
  ENSP ID: ENSP00000456935

SEQ ID NO: 12966 - protein, 133 aa, Homo sapiens
  Payload ID: 2526
  Gene Symbol: CD2
  Gene Name: CD2 molecule
  ENSP ID: ENSP00000358489
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQGKCSFP

SEQ ID NO: 12967 - protein, 351 aa, Homo sapiens
  Payload ID: 2526
  Gene Symbol: CD2
  Gene Name: CD2 molecule
  Uniprot ID: P06729
  ENSP ID: ENSP00000358490
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 12968 - protein, 269 aa, Homo sapiens
  Payload ID: 2527
  Gene Symbol: CD200
  Gene Name: CD200 molecule
  Uniprot ID: P41217
  ENSP ID: ENSP00000312766
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 12969 - protein, 195 aa, Homo sapiens
  Payload ID: 2527
  Gene Symbol: CD200
  Gene Name: CD200 molecule
  ENSP ID: ENSP00000373179
MVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 12970 - protein, 150 aa, Homo sapiens
  Payload ID: 2527
  Gene Symbol: CD200
  Gene Name: CD200 molecule
  ENSP ID: ENSP00000418576
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYAHSIPSLQIL

SEQ ID NO: 12971 - protein, 76 aa, Homo sapiens
  Payload ID: 2527
  Gene Symbol: CD200
  Gene Name: CD200 molecule
  ENSP ID: ENSP00000419816
MVTFSENHGVVIQPAYKDKINITQLGLQNSTITFWNITLEDEGCYMCLFNTFGFGKISGTACLTVYAHSIPSLQIL

SEQ ID NO: 12972 - protein, 294 aa, Homo sapiens
  Payload ID: 2527
  Gene Symbol: CD200
  Gene Name: CD200 molecule
  Uniprot ID: P41217
  ENSP ID: ENSP00000420298
MERLTLTRTIGGPLLTATLLGKTTINDYQVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 12973 - protein, 202 aa, Homo sapiens
  Payload ID: 2527
  Gene Symbol: CD200
  Gene Name: CD200 molecule
  ENSP ID: ENSP00000475860
MKVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNK

SEQ ID NO: 12974 - protein, 62 aa, Homo sapiens
  Payload ID: 2527
  Gene Symbol: CD200
  Gene Name: CD200 molecule
  ENSP ID: ENSP00000476114
MPFSHLSTYSLVWVMAAVVLCTAQVQVVTQDEREQLYTPASLKCSLQNAQEALIVTWQKKKA

SEQ ID NO: 12975 - protein, 212 aa, Homo sapiens
  Payload ID: 2528
  Gene Symbol: CD200R1
  Gene Name: CD200 receptor 1
  ENSP ID: ENSP00000295863
MLCPWRTANLGLLLILTIFLVAVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPG

SEQ ID NO: 12976 - protein, 348 aa, Homo sapiens
  Payload ID: 2528
  Gene Symbol: CD200R1
  Gene Name: CD200 receptor 1
  Uniprot ID: Q8TD46
  ENSP ID: ENSP00000311035
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 12977 - protein, 188 aa, Homo sapiens
  Payload ID: 2528
  Gene Symbol: CD200R1
  Gene Name: CD200 receptor 1
  Uniprot ID: Q8TD46
  ENSP ID: ENSP00000405733
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLGKEHHILRYFTSPDL

SEQ ID NO: 12978 - protein, 165 aa, Homo sapiens
  Payload ID: 2528
  Gene Symbol: CD200R1
  Gene Name: CD200 receptor 1
  Uniprot ID: Q8TD46
  ENSP ID: ENSP00000418801
MLCPWRTANLGLLLILTIFLVAASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLGKEHHILRYFTSPDL

SEQ ID NO: 12979 - protein, 325 aa, Homo sapiens
  Payload ID: 2528
  Gene Symbol: CD200R1
  Gene Name: CD200 receptor 1
  Uniprot ID: Q8TD46
  ENSP ID: ENSP00000418928
MLCPWRTANLGLLLILTIFLVAASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 12980 - protein, 271 aa, Homo sapiens
  Payload ID: 2529
  Gene Symbol: CD200R1L
  Gene Name: CD200 receptor 1-like
  Uniprot ID: Q6Q8B3
  ENSP ID: ENSP00000381272
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 12981 - protein, 250 aa, Homo sapiens
  Payload ID: 2529
  Gene Symbol: CD200R1L
  Gene Name: CD200 receptor 1-like
  ENSP ID: ENSP00000415132
MGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVSKFL

SEQ ID NO: 12982 - protein, 250 aa, Homo sapiens
  Payload ID: 2529
  Gene Symbol: CD200R1L
  Gene Name: CD200 receptor 1-like
  Uniprot ID: Q6Q8B3
  ENSP ID: ENSP00000418413
MGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 12983 - protein, 55 aa, Homo sapiens
  Payload ID: 2529
  Gene Symbol: CD200R1L
  Gene Name: CD200 receptor 1-like
  ENSP ID: ENSP00000420461
MSAPRLLISIIIMVSGCTGSMAEEASKNLQSWWKCEGEASMSSNGQQKPQIIIPV

SEQ ID NO: 12984 - protein, 253 aa, Homo sapiens
  Payload ID: 2529
  Gene Symbol: CD200R1L
  Gene Name: CD200 receptor 1-like
  ENSP ID: ENSP00000477541
ASSSSCMGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVR

SEQ ID NO: 12985 - protein, 328 aa, Homo sapiens
  Payload ID: 2530
  Gene Symbol: CD207
  Gene Name: CD207 molecule, langerin
  Uniprot ID: Q9UJ71
  ENSP ID: ENSP00000386378
MTVEKEAPDAHFTVDKQNISLWPREPPPKSGPSLVPGKTPTVRAALICLTLVLVASVLLQAVLYPRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 12986 - protein, 360 aa, Homo sapiens
  Payload ID: 2531
  Gene Symbol: CD209
  Gene Name: CD209 molecule
  Uniprot ID: Q9NNX6
  ENSP ID: ENSP00000204801
MSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12987 - protein, 380 aa, Homo sapiens
  Payload ID: 2531
  Gene Symbol: CD209
  Gene Name: CD209 molecule
  Uniprot ID: Q9NNX6
  ENSP ID: ENSP00000315407
MSDSKEPRLQQLGLLEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12988 - protein, 404 aa, Homo sapiens
  Payload ID: 2531
  Gene Symbol: CD209
  Gene Name: CD209 molecule
  Uniprot ID: Q9NNX6
  ENSP ID: ENSP00000315477
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12989 - protein, 398 aa, Homo sapiens
  Payload ID: 2531
  Gene Symbol: CD209
  Gene Name: CD209 molecule
  Uniprot ID: Q9NNX6
  ENSP ID: ENSP00000346373
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12990 - protein, 168 aa, Homo sapiens
  Payload ID: 2531
  Gene Symbol: CD209
  Gene Name: CD209 molecule
  Uniprot ID: Q9NNX6
  ENSP ID: ENSP00000377716
MSDSKEPRLQQLGLLEEEQLRGLGFRQTRGYKSLAGCLGHGPLVLQLLSFTLLAGLLVQVSKVPSSISQEQSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12991 - protein, 243 aa, Homo sapiens
  Payload ID: 2531
  Gene Symbol: CD209
  Gene Name: CD209 molecule
  ENSP ID: ENSP00000377728
MSDSKEPRLQQLGLLEEEQLRGLGFRQTRGYKSLAGCLGHGPLVLQLLSFTLLAGLLVQVSKVPSSISQEQSRQDAIYQNLTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12992 - protein, 380 aa, Homo sapiens
  Payload ID: 2531
  Gene Symbol: CD209
  Gene Name: CD209 molecule
  Uniprot ID: Q9NNX6
  ENSP ID: ENSP00000468827
MASACPGSDFTSIHSEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12993 - protein, 334 aa, Homo sapiens
  Payload ID: 2531
  Gene Symbol: CD209
  Gene Name: CD209 molecule
  ENSP ID: ENSP00000470530
MASACPGSDFTSIHSEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12994 - protein, 297 aa, Homo sapiens
  Payload ID: 2531
  Gene Symbol: CD209
  Gene Name: CD209 molecule
  Uniprot ID: Q9NNX6
  ENSP ID: ENSP00000470658
MASACPGSDFTSIHSEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQLQAVLEQRRAQQRWGGRLRGI

SEQ ID NO: 12995 - protein, 312 aa, Homo sapiens
  Payload ID: 2531
  Gene Symbol: CD209
  Gene Name: CD209 molecule
  Uniprot ID: Q9NNX6
  ENSP ID: ENSP00000471137
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12996 - protein, 268 aa, Homo sapiens
  Payload ID: 2531
  Gene Symbol: CD209
  Gene Name: CD209 molecule
  ENSP ID: ENSP00000471348
MSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 12997 - protein, 847 aa, Homo sapiens
  Payload ID: 2532
  Gene Symbol: CD22
  Gene Name: CD22 molecule
  Uniprot ID: P20273
  ENSP ID: ENSP00000085219
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 12998 - protein, 647 aa, Homo sapiens
  Payload ID: 2532
  Gene Symbol: CD22
  Gene Name: CD22 molecule
  ENSP ID: ENSP00000270311
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGTMRTSFQIFQKMRGFITQS

SEQ ID NO: 12999 - protein, 670 aa, Homo sapiens
  Payload ID: 2532
  Gene Symbol: CD22
  Gene Name: CD22 molecule
  Uniprot ID: P20273
  ENSP ID: ENSP00000339349
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 13000 - protein, 675 aa, Homo sapiens
  Payload ID: 2532
  Gene Symbol: CD22
  Gene Name: CD22 molecule
  Uniprot ID: P20273
  ENSP ID: ENSP00000403822
MSLWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 13001 - protein, 751 aa, Homo sapiens
  Payload ID: 2532
  Gene Symbol: CD22
  Gene Name: CD22 molecule
  Uniprot ID: P20273
  ENSP ID: ENSP00000441237
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKRCRVLRDAETSPGLR

SEQ ID NO: 13002 - protein, 759 aa, Homo sapiens
  Payload ID: 2532
  Gene Symbol: CD22
  Gene Name: CD22 molecule
  Uniprot ID: P20273
  ENSP ID: ENSP00000442279
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 13003 - protein, 144 aa, Homo sapiens
  Payload ID: 2532
  Gene Symbol: CD22
  Gene Name: CD22 molecule
  ENSP ID: ENSP00000469503
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQ

SEQ ID NO: 13004 - protein, 164 aa, Homo sapiens
  Payload ID: 2532
  Gene Symbol: CD22
  Gene Name: CD22 molecule
  ENSP ID: ENSP00000469523
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSDPPKKVTTVIQNPMPIREGDTVTLSCN

SEQ ID NO: 13005 - protein, 106 aa, Homo sapiens
  Payload ID: 2532
  Gene Symbol: CD22
  Gene Name: CD22 molecule
  ENSP ID: ENSP00000469980
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSI

SEQ ID NO: 13006 - protein, 670 aa, Homo sapiens; identical to SEQ ID NO: 12999
  Payload ID: 2532
  Gene Symbol: CD22
  Gene Name: CD22 molecule
  Uniprot ID: P20273
  ENSP ID: ENSP00000469984

SEQ ID NO: 13007 - protein, 191 aa, Homo sapiens
  Payload ID: 2532
  Gene Symbol: CD22
  Gene Name: CD22 molecule
  ENSP ID: ENSP00000470193
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSVAPRGGSNEAGCCHLDLLDHQVCLHPERAQVLPTVESPWEDCDLPASGCRWEVPLQ

SEQ ID NO: 13008 - protein, 38 aa, Homo sapiens
  Payload ID: 2532
  Gene Symbol: CD22
  Gene Name: CD22 molecule
  ENSP ID: ENSP00000470681
MHLLGPWLLLLVNGFLSTLKPSTPGRGPASGSPAPTEP

SEQ ID NO: 13009 - protein, 148 aa, Homo sapiens
  Payload ID: 2532
  Gene Symbol: CD22
  Gene Name: CD22 molecule
  ENSP ID: ENSP00000470724
VLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSVESPWEDCDLPASGCRWEVPLQ

SEQ ID NO: 13010 - protein, 158 aa, Homo sapiens
  Payload ID: 2532
  Gene Symbol: CD22
  Gene Name: CD22 molecule
  ENSP ID: ENSP00000471399
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSDPPKKVTTVIQNPMPIREGDTVT

SEQ ID NO: 13011 - protein, 225 aa, Homo sapiens
  Payload ID: 2532
  Gene Symbol: CD22
  Gene Name: CD22 molecule
  ENSP ID: ENSP00000471972
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDAD

SEQ ID NO: 13012 - protein, 133 aa, Homo sapiens
  Payload ID: 2532
  Gene Symbol: CD22
  Gene Name: CD22 molecule
  ENSP ID: ENSP00000472664
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIH

SEQ ID NO: 13013 - protein, 137 aa, Homo sapiens
  Payload ID: 2532
  Gene Symbol: CD22
  Gene Name: CD22 molecule
  ENSP ID: ENSP00000472762
MHLLGPWLLLLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSER

SEQ ID NO: 13014 - protein, 145 aa, Homo sapiens
  Payload ID: 2532
  Gene Symbol: CD22
  Gene Name: CD22 molecule
  ENSP ID: ENSP00000473221
NPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQ

SEQ ID NO: 13015 - protein, 153 aa, Homo sapiens
  Payload ID: 2532
  Gene Symbol: CD22
  Gene Name: CD22 molecule
  ENSP ID: ENSP00000482823
HIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKRESPRHACGKGKVCVTFSPAPQGACTQGRGKPAQTAASSSPGHAALSALVFREKDLL

SEQ ID NO: 13016 - protein, 336 aa, Homo sapiens
  Payload ID: 2533
  Gene Symbol: CD226
  Gene Name: CD226 molecule
  Uniprot ID: Q15762
  ENSP ID: ENSP00000280200
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 13017 - protein, 336 aa, Homo sapiens; identical to SEQ ID NO: 13016
  Payload ID: 2533
  Gene Symbol: CD226
  Gene Name: CD226 molecule
  Uniprot ID: Q15762
  ENSP ID: ENSP00000461947

SEQ ID NO: 13018 - protein, 181 aa, Homo sapiens
  Payload ID: 2533
  Gene Symbol: CD226
  Gene Name: CD226 molecule
  ENSP ID: ENSP00000462453
MTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 13019 - protein, 37 aa, Homo sapiens
  Payload ID: 2533
  Gene Symbol: CD226
  Gene Name: CD226 molecule
  ENSP ID: ENSP00000463152
IVIPDVTVSDSGLYRCYLQASAGENETFVMRLTVAEG

SEQ ID NO: 13020 - protein, 127 aa, Homo sapiens
  Payload ID: 2533
  Gene Symbol: CD226
  Gene Name: CD226 molecule
  ENSP ID: ENSP00000463335
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQS

SEQ ID NO: 13021 - protein, 276 aa, Homo sapiens
  Payload ID: 2533
  Gene Symbol: CD226
  Gene Name: CD226 molecule
  ENSP ID: ENSP00000463927
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLN

SEQ ID NO: 13022 - protein, 181 aa, Homo sapiens; identical to SEQ ID NO: 13018
  Payload ID: 2533
  Gene Symbol: CD226
  Gene Name: CD226 molecule
  ENSP ID: ENSP00000464084

SEQ ID NO: 13023 - protein, 132 aa, Homo sapiens
  Payload ID: 2533
  Gene Symbol: CD226
  Gene Name: CD226 molecule
  ENSP ID: ENSP00000464334
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEA

SEQ ID NO: 13024 - protein, 80 aa, Homo sapiens
  Payload ID: 2534
  Gene Symbol: CD24
  Gene Name: CD24 molecule
  ENSP ID: ENSP00000475625
MGRAMVARLGLGLLLLALLLPTQIYSSETTTGTSSNSSQSTSNSGLAPNPTNATTKAAGGALQSTASLFVVSLSLLHLYS

SEQ ID NO: 13025 - protein, 37 aa, Homo sapiens
  Payload ID: 2534
  Gene Symbol: CD24
  Gene Name: CD24 molecule
  ENSP ID: ENSP00000478302
MGRAMVARLGLGLLLLALLLPTQKMLRIPNLIDLKNM

SEQ ID NO: 13026 - protein, 88 aa, Homo sapiens
  Payload ID: 2534
  Gene Symbol: CD24
  Gene Name: CD24 molecule
  ENSP ID: ENSP00000478460
  MOD_RES (1)..(1): Any amino acid
XDRSGPGHRLRGAPTSREGFALGGARVPSARIYSSETTTGTSSNSSQSTSNSGLAPNPTNATTKAAGGALQSTASLFVVSLSLLHLYS

SEQ ID NO: 13027 - protein, 122 aa, Homo sapiens
  Payload ID: 2534
  Gene Symbol: CD24
  Gene Name: CD24 molecule
  ENSP ID: ENSP00000479895
  MOD_RES (1)..(1): Any amino acid
XLSSAAGREITLPEGSRRPPPTRSHWNSQPLSGPRGAFCSLSGNALAPGQAATPPQRRRGLFFWGIYSSETTTGTSSNSSQSTSNSGLAPNPTNATTKAAGGALQSTASLFVVSLSLLHLYS

SEQ ID NO: 13028 - protein, 129 aa, Homo sapiens
  Payload ID: 2534
  Gene Symbol: CD24
  Gene Name: CD24 molecule
  ENSP ID: ENSP00000481841
MVGRFCPESPPGFVRVAATSAVSLDPPSGEPRPGCGYPGPRSAASRVYGCTAPARETGGWAWETLAGAGAKKIYSSETTTGTSSNSSQSTSNSGLAPNPTNATTKAAGGALQSTASLFVVSLSLLHLYS

SEQ ID NO: 13029 - protein, 80 aa, Homo sapiens; identical to SEQ ID NO: 13024
  Payload ID: 2534
  Gene Symbol: CD24
  Gene Name: CD24 molecule
  ENSP ID: ENSP00000483838

SEQ ID NO: 13030 - protein, 80 aa, Homo sapiens; identical to SEQ ID NO: 13024
  Payload ID: 2534
  Gene Symbol: CD24
  Gene Name: CD24 molecule
  ENSP ID: ENSP00000483985

SEQ ID NO: 13031 - protein, 273 aa, Homo sapiens
  Payload ID: 2535
  Gene Symbol: CD244
  Gene Name: CD244 molecule, natural killer cell receptor 2B4
  Uniprot ID: Q9BZW8
  ENSP ID: ENSP00000313619
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 13032 - protein, 370 aa, Homo sapiens
  Payload ID: 2535
  Gene Symbol: CD244
  Gene Name: CD244 molecule, natural killer cell receptor 2B4
  Uniprot ID: Q9BZW8
  ENSP ID: ENSP00000357012
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFESLLPDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 13033 - protein, 365 aa, Homo sapiens
  Payload ID: 2535
  Gene Symbol: CD244
  Gene Name: CD244 molecule, natural killer cell receptor 2B4
  Uniprot ID: Q9BZW8
  ENSP ID: ENSP00000357013
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 13034 - protein, 329 aa, Homo sapiens
  Payload ID: 2535
  Gene Symbol: CD244
  Gene Name: CD244 molecule, natural killer cell receptor 2B4
  Uniprot ID: Q9BZW8
  ENSP ID: ENSP00000432636
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKGDRFYSFSG

SEQ ID NO: 13035 - protein, 164 aa, Homo sapiens
  Payload ID: 2536
  Gene Symbol: CD247
  Gene Name: CD247 molecule
  Uniprot ID: P20963
  ENSP ID: ENSP00000354782
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 13036 - protein, 163 aa, Homo sapiens
  Payload ID: 2536
  Gene Symbol: CD247
  Gene Name: CD247 molecule
  Uniprot ID: P20963
  ENSP ID: ENSP00000375969
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13037 - protein, 757 aa, Homo sapiens
  Payload ID: 2537
  Gene Symbol: CD248
  Gene Name: CD248 molecule, endosialin
  Uniprot ID: Q9HCU0
  ENSP ID: ENSP00000308117
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 13038 - protein, 260 aa, Homo sapiens
  Payload ID: 2538
  Gene Symbol: CD27
  Gene Name: CD27 molecule
  Uniprot ID: P26842
  ENSP ID: ENSP00000266557
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 13039 - protein, 176 aa, Homo sapiens
  Payload ID: 2539
  Gene Symbol: CD274
  Gene Name: CD274 molecule
  Uniprot ID: Q9NZQ7
  ENSP ID: ENSP00000370985
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 13040 - protein, 290 aa, Homo sapiens
  Payload ID: 2539
  Gene Symbol: CD274
  Gene Name: CD274 molecule
  Uniprot ID: Q9NZQ7
  ENSP ID: ENSP00000370989
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 13041 - protein, 316 aa, Homo sapiens
  Payload ID: 2540
  Gene Symbol: CD276
  Gene Name: CD276 molecule
  Uniprot ID: Q5ZPR3
  ENSP ID: ENSP00000320058
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 13042 - protein, 534 aa, Homo sapiens
  Payload ID: 2540
  Gene Symbol: CD276
  Gene Name: CD276 molecule
  Uniprot ID: Q5ZPR3
  ENSP ID: ENSP00000320084
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 13043 - protein, 388 aa, Homo sapiens
  Payload ID: 2540
  Gene Symbol: CD276
  Gene Name: CD276 molecule
  ENSP ID: ENSP00000441087
MTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 13044 - protein, 156 aa, Homo sapiens
  Payload ID: 2540
  Gene Symbol: CD276
  Gene Name: CD276 molecule
  ENSP ID: ENSP00000452649
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLR

SEQ ID NO: 13045 - protein, 165 aa, Homo sapiens
  Payload ID: 2540
  Gene Symbol: CD276
  Gene Name: CD276 molecule
  ENSP ID: ENSP00000452669
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITC

SEQ ID NO: 13046 - protein, 533 aa, Homo sapiens
  Payload ID: 2540
  Gene Symbol: CD276
  Gene Name: CD276 molecule
  Uniprot ID: Q5ZPR3
  ENSP ID: ENSP00000452736
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEGKDTWA

SEQ ID NO: 13047 - protein, 51 aa, Homo sapiens
  Payload ID: 2540
  Gene Symbol: CD276
  Gene Name: CD276 molecule
  ENSP ID: ENSP00000452905
MLRRRGSPGMGVHVGAALGALWFCLTGALEVQVPEDPVVALVGTDATLCCS

SEQ ID NO: 13048 - protein, 199 aa, Homo sapiens
  Payload ID: 2540
  Gene Symbol: CD276
  Gene Name: CD276 molecule
  ENSP ID: ENSP00000453014
  MOD_RES (1)..(1): Any amino acid
XRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITEALWVTVGLSVCLIALLVALAFVCWRKIKQSCEEENAGAEDQDGEGEGSKTALQPLKHSDSKEDDGQEIA

SEQ ID NO: 13049 - protein, 38 aa, Homo sapiens
  Payload ID: 2540
  Gene Symbol: CD276
  Gene Name: CD276 molecule
  ENSP ID: ENSP00000453330
MLRRRGSPGMGVHVGAALGALWFCLTADRYQTAGAQLC

SEQ ID NO: 13050 - protein, 132 aa, Homo sapiens
  Payload ID: 2540
  Gene Symbol: CD276
  Gene Name: CD276 molecule
  ENSP ID: ENSP00000453336
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSA

SEQ ID NO: 13051 - protein, 170 aa, Homo sapiens
  Payload ID: 2540
  Gene Symbol: CD276
  Gene Name: CD276 molecule
  ENSP ID: ENSP00000453842
  MOD_RES (1)..(1): Any amino acid
XTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 13052 - protein, 136 aa, Homo sapiens
  Payload ID: 2540
  Gene Symbol: CD276
  Gene Name: CD276 molecule
  ENSP ID: ENSP00000453907
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSL

SEQ ID NO: 13053 - protein, 146 aa, Homo sapiens
  Payload ID: 2540
  Gene Symbol: CD276
  Gene Name: CD276 molecule
  ENSP ID: ENSP00000454258
MSLKAPMSSRKKKLYLQQHCEAGAAFHHGEPSCQPPHRKMLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASL

SEQ ID NO: 13054 - protein, 316 aa, Homo sapiens; identical to SEQ ID NO: 13041
  Payload ID: 2540
  Gene Symbol: CD276
  Gene Name: CD276 molecule
  Uniprot ID: Q5ZPR3
  ENSP ID: ENSP00000454940

SEQ ID NO: 13055 - protein, 132 aa, Homo sapiens; identical to SEQ ID NO: 13050
  Payload ID: 2540
  Gene Symbol: CD276
  Gene Name: CD276 molecule
  ENSP ID: ENSP00000455366

SEQ ID NO: 13056 - protein, 38 aa, Homo sapiens; identical to SEQ ID NO: 13049
  Payload ID: 2540
  Gene Symbol: CD276
  Gene Name: CD276 molecule
  ENSP ID: ENSP00000456657

SEQ ID NO: 13057 - protein, 220 aa, Homo sapiens
  Payload ID: 2541
  Gene Symbol: CD28
  Gene Name: CD28 molecule
  Uniprot ID: P10747
  ENSP ID: ENSP00000324890
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 13058 - protein, 101 aa, Homo sapiens
  Payload ID: 2541
  Gene Symbol: CD28
  Gene Name: CD28 molecule
  Uniprot ID: P10747
  ENSP ID: ENSP00000363605
MLRLLLALNLFPSIQVTGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 13059 - protein, 234 aa, Homo sapiens
  Payload ID: 2541
  Gene Symbol: CD28
  Gene Name: CD28 molecule
  Uniprot ID: P10747
  ENSP ID: ENSP00000393648
MPCGLSALIMCPKGMVAVVVAVDDGDSQALAGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 13060 - protein, 639 aa, Homo sapiens
  Payload ID: 2542
  Gene Symbol: CD2AP
  Gene Name: CD2-associated protein
  Uniprot ID: Q9Y5K6
  ENSP ID: ENSP00000352264
MVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSANLKPSELKKDTCYSPKPSVYLSTPSSASKANTTAFLTPLEIKAKVETDDVKKNSLDELRAQIIELLCIVEALKKDHGKELEKLRKDLEEEKTMRSNLEMEIEKLKKAVLSS

SEQ ID NO: 13061 - protein, 148 aa, Homo sapiens
  Payload ID: 2543
  Gene Symbol: CD300LB
  Gene Name: CD300 molecule-like family member b
  ENSP ID: ENSP00000317337
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKR

SEQ ID NO: 13062 - protein, 201 aa, Homo sapiens
  Payload ID: 2543
  Gene Symbol: CD300LB
  Gene Name: CD300 molecule-like family member b
  Uniprot ID: A8K4G0
  ENSP ID: ENSP00000376397
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 13063 - protein, 194 aa, Homo sapiens
  Payload ID: 2544
  Gene Symbol: CD300LD
  Gene Name: CD300 molecule-like family member d
  Uniprot ID: Q6UXZ3
  ENSP ID: ENSP00000364501
MWLSPSLLLLILPGYSIAAKITGPTTVNGSEQGSLTVQCAYGSGWETYLKWRCQGADWNYCNILVKTNGSEQEVKKNRVSIRDNQKNHVFTVTMENLKRDDADSYWCGTERPGIDLGVKVQVTINPGTQTAVSEWTTTTASLAFTAAATQKTSSPLTRSPLKSTHFLFLFLLELPLLLSMLGTVLWVNRPQRRS

SEQ ID NO: 13064 - protein, 244 aa, Homo sapiens
  Payload ID: 2545
  Gene Symbol: CD300LF
  Gene Name: CD300 molecule-like family member f
  Uniprot ID: Q8TDQ1
  ENSP ID: ENSP00000301573
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRSEGSQAANYRPAAHQAQAPEAQCPPAPHLHHIAAAFGGRLTLGLEDDEVPAESSRDVPRAGTAAPGGRPLLCRPDPAAGRNLPAKGYHEAFLCPG

SEQ ID NO: 13065 - protein, 290 aa, Homo sapiens
  Payload ID: 2545
  Gene Symbol: CD300LF
  Gene Name: CD300 molecule-like family member f
  Uniprot ID: Q8TDQ1
  ENSP ID: ENSP00000327075
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 13066 - protein, 194 aa, Homo sapiens
  Payload ID: 2545
  Gene Symbol: CD300LF
  Gene Name: CD300 molecule-like family member f
  Uniprot ID: Q8TDQ1
  ENSP ID: ENSP00000343751
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNSSRDVPRAGTAAPGGRPLLCRPDPAAGRNLPAKGYHEAFLCPG

SEQ ID NO: 13067 - protein, 239 aa, Homo sapiens
  Payload ID: 2545
  Gene Symbol: CD300LF
  Gene Name: CD300 molecule-like family member f
  Uniprot ID: Q8TDQ1
  ENSP ID: ENSP00000355294
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPASTPAPTTPTSTTFTAPVTQEETSSSPTLTGHHLDNRHKLLKLSVLLPLIFTILLLLLVAASLLAWRMMKYQQKGTAAPGGRPLLCRPDPAAGRNLPAKGYHEAFLCPG

SEQ ID NO: 13068 - protein, 305 aa, Homo sapiens
  Payload ID: 2545
  Gene Symbol: CD300LF
  Gene Name: CD300 molecule-like family member f
  ENSP ID: ENSP00000462309
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPASTPAPTTPTSTTFTAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 13069 - protein, 194 aa, Homo sapiens; identical to SEQ ID NO: 13066
  Payload ID: 2545
  Gene Symbol: CD300LF
  Gene Name: CD300 molecule-like family member f
  Uniprot ID: Q8TDQ1
  ENSP ID: ENSP00000463743

SEQ ID NO: 13070 - protein, 165 aa, Homo sapiens
  Payload ID: 2545
  Gene Symbol: CD300LF
  Gene Name: CD300 molecule-like family member f
  Uniprot ID: Q8TDQ1
  ENSP ID: ENSP00000464223
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRYCSPWRATSAMQT

SEQ ID NO: 13071 - protein, 293 aa, Homo sapiens
  Payload ID: 2545
  Gene Symbol: CD300LF
  Gene Name: CD300 molecule-like family member f
  Uniprot ID: Q8TDQ1
  ENSP ID: ENSP00000464257
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 13072 - protein, 239 aa, Homo sapiens; identical to SEQ ID NO: 13067
  Payload ID: 2545
  Gene Symbol: CD300LF
  Gene Name: CD300 molecule-like family member f
  Uniprot ID: Q8TDQ1
  ENSP ID: ENSP00000464610

SEQ ID NO: 13073 - protein, 233 aa, Homo sapiens
  Payload ID: 2546
  Gene Symbol: CD300LG
  Gene Name: CD300 molecule-like family member g
  Uniprot ID: Q6UXG3
  ENSP ID: ENSP00000293396
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGSSRPPMQLDSTSAEDTSPALSSGSSKPRVSIPMVRILAPVLVLLSLLSAAGLIAFCSHLLLWRKEAQQATETQRNEKFCLSRLNHRTSELDPDEAFEISSLTFLSV

SEQ ID NO: 13074 - protein, 332 aa, Homo sapiens
  Payload ID: 2546
  Gene Symbol: CD300LG
  Gene Name: CD300 molecule-like family member g
  Uniprot ID: Q6UXG3
  ENSP ID: ENSP00000321005
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLTAEEKEAPSQAPEGDVISMPPLHTSEEELGFSKFVSA

SEQ ID NO: 13075 - protein, 273 aa, Homo sapiens
  Payload ID: 2546
  Gene Symbol: CD300LG
  Gene Name: CD300 molecule-like family member g
  Uniprot ID: Q6UXG3
  ENSP ID: ENSP00000366408
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPASPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 13076 - protein, 307 aa, Homo sapiens
  Payload ID: 2546
  Gene Symbol: CD300LG
  Gene Name: CD300 molecule-like family member g
  Uniprot ID: Q6UXG3
  ENSP ID: ENSP00000442368
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 13077 - protein, 150 aa, Homo sapiens
  Payload ID: 2546
  Gene Symbol: CD300LG
  Gene Name: CD300 molecule-like family member g
  ENSP ID: ENSP00000465863
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGNRYLSFPRLGTGAAEGRGRGGGA

SEQ ID NO: 13078 - protein, 222 aa, Homo sapiens
  Payload ID: 2546
  Gene Symbol: CD300LG
  Gene Name: CD300 molecule-like family member g
  Uniprot ID: Q6UXG3
  ENSP ID: ENSP00000468800
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 13079 - protein, 186 aa, Homo sapiens
  Payload ID: 2547
  Gene Symbol: CD300A
  Gene Name: CD300a molecule
  Uniprot ID: Q9UGN4
  ENSP ID: ENSP00000308188
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 13080 - protein, 299 aa, Homo sapiens
  Payload ID: 2547
  Gene Symbol: CD300A
  Gene Name: CD300a molecule
  Uniprot ID: Q9UGN4
  ENSP ID: ENSP00000353259
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 13081 - protein, 103 aa, Homo sapiens
  Payload ID: 2547
  Gene Symbol: CD300A
  Gene Name: CD300a molecule
  Uniprot ID: Q9UGN4
  ENSP ID: ENSP00000354564
MWLPWALLLLWVPAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 13082 - protein, 150 aa, Homo sapiens
  Payload ID: 2547
  Gene Symbol: CD300A
  Gene Name: CD300a molecule
  Uniprot ID: Q9UGN4
  ENSP ID: ENSP00000376401
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQASPREELHYASVVFDSNTNRIAAQRPREEEPDSDYSVIRKT

SEQ ID NO: 13083 - protein, 169 aa, Homo sapiens
  Payload ID: 2547
  Gene Symbol: CD300A
  Gene Name: CD300a molecule
  ENSP ID: ENSP00000463189
MTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 13084 - protein, 224 aa, Homo sapiens
  Payload ID: 2548
  Gene Symbol: CD300C
  Gene Name: CD300c molecule
  Uniprot ID: Q08708
  ENSP ID: ENSP00000329507
MTARAWASWRSSALLLLLVPGYFPLSHPMTVAGPVGGSLSVQCRYEKEHRTLNKFWCRPPQILRCDKIVETKGSAGKRNGRVSIRDSPANLSFTVTLENLTEEDAGTYWCGVDTPWLRDFHDPIVEVEVSVFPAGTTTASSPQSSMGTSGPPTKLPVHTWPSVTRKDSPEPSPHPGSLFSNVRFLLLVLLELPLLLSMLGAVLWVNRPQRSSRSRQNWPKGENQ

SEQ ID NO: 13085 - protein, 205 aa, Homo sapiens
  Payload ID: 2549
  Gene Symbol: CD300E
  Gene Name: CD300e molecule
  Uniprot ID: Q496F6
  ENSP ID: ENSP00000376395
MWLLPALLLLCLSGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSGFRLSSPHFLLVVLLKLPLLLSMLGAVFWVNRPQWAPPGR

SEQ ID NO: 13086 - protein, 121 aa, Homo sapiens
  Payload ID: 2549
  Gene Symbol: CD300E
  Gene Name: CD300e molecule
  ENSP ID: ENSP00000415488
MCHLQEEAGGRWKGGGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDP

SEQ ID NO: 13087 - protein, 232 aa, Homo sapiens
  Payload ID: 2550
  Gene Symbol: CD302
  Gene Name: CD302 molecule
  Uniprot ID: Q8IX05
  ENSP ID: ENSP00000259053
MLRAALPALLLPLLGLAAAAVADCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 13088 - protein, 174 aa, Homo sapiens
  Payload ID: 2550
  Gene Symbol: CD302
  Gene Name: CD302 molecule
  Uniprot ID: Q8IX05
  ENSP ID: ENSP00000394301
MLRAALPALLLPLLGLAAAAVADCPSSTWIQFQDSCYIFLQEAIKVESIEDVRNQCTDHGADMISIHNEEENAFILDTLKKQWKGPDDILLGMFYDTDVPYKRKYLSDNHILISALVIASTVILTVLGAIIWFLYKKHSDSRFTTVFSTAPQSPYNEDCVLVVGEENEYPVQFD

SEQ ID NO: 13089 - protein, 195 aa, Homo sapiens
  Payload ID: 2550
  Gene Symbol: CD302
  Gene Name: CD302 molecule
  ENSP ID: ENSP00000451446
MLRAALPALLLPLLGLAAAAVAGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 13090 - protein, 282 aa, Homo sapiens
  Payload ID: 2551
  Gene Symbol: CD320
  Gene Name: CD320 molecule
  Uniprot ID: Q9NPF0
  ENSP ID: ENSP00000301458
MSGGWMAQVGAWRTGALGLALLLLLGLGLGLEAAASPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 13091 - protein, 240 aa, Homo sapiens
  Payload ID: 2551
  Gene Symbol: CD320
  Gene Name: CD320 molecule
  Uniprot ID: Q9NPF0
  ENSP ID: ENSP00000437697
MSGGWMAQVGAWRTGALGLALLLLLGLGLGLEAAASPLSTPTSAQAAGIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 13092 - protein, 88 aa, Homo sapiens
  Payload ID: 2551
  Gene Symbol: CD320
  Gene Name: CD320 molecule
  ENSP ID: ENSP00000471551
  MOD_RES (1)..(1): Any amino acid
XQVGAWRTGALGLALLLLLGLGLGLEAAASPLSTPTSAQAAGPSSGSCPPTKFQCRTSGLCVPLTWRCDRDLDCSDGSDEEECTAWPA

SEQ ID NO: 13093 - protein, 81 aa, Homo sapiens
  Payload ID: 2551
  Gene Symbol: CD320
  Gene Name: CD320 molecule
  ENSP ID: ENSP00000471773
MSGGWMAQVGAWRTGALGLALLLLLGLGLGLEAAASPLSTPTSAQAADHLAMRSLVKTLGSARPEFEAQLRYQLFFFSFLW

SEQ ID NO: 13094 - protein, 364 aa, Homo sapiens
  Payload ID: 2552
  Gene Symbol: CD33
  Gene Name: CD33 molecule
  Uniprot ID: P20138
  ENSP ID: ENSP00000262262
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 13095 - protein, 310 aa, Homo sapiens
  Payload ID: 2552
  Gene Symbol: CD33
  Gene Name: CD33 molecule
  Uniprot ID: P20138
  ENSP ID: ENSP00000375673
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVR

SEQ ID NO: 13096 - protein, 212 aa, Homo sapiens
  Payload ID: 2552
  Gene Symbol: CD33
  Gene Name: CD33 molecule
  ENSP ID: ENSP00000403331
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVSDGASWHPVCPADTSSQCGPPSCPIQHFQN

SEQ ID NO: 13097 - protein, 237 aa, Homo sapiens
  Payload ID: 2552
  Gene Symbol: CD33
  Gene Name: CD33 molecule
  Uniprot ID: P20138
  ENSP ID: ENSP00000410126
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 13098 - protein, 385 aa, Homo sapiens
  Payload ID: 2553
  Gene Symbol: CD34
  Gene Name: CD34 molecule
  Uniprot ID: P28906
  ENSP ID: ENSP00000310036
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 13099 - protein, 328 aa, Homo sapiens
  Payload ID: 2553
  Gene Symbol: CD34
  Gene Name: CD34 molecule
  Uniprot ID: P28906
  ENSP ID: ENSP00000348916
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLELEP

SEQ ID NO: 13100 - protein, 227 aa, Homo sapiens
  Payload ID: 2553
  Gene Symbol: CD34
  Gene Name: CD34 molecule
  ENSP ID: ENSP00000356003
MDFGPGRLFRFFSYCVVAHIQLAVFFFSVGILETRILLADGAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 13101 - protein, 472 aa, Homo sapiens
  Payload ID: 2554
  Gene Symbol: CD36
  Gene Name: CD36 molecule (thrombospondin receptor)
  Uniprot ID: P16671
  ENSP ID: ENSP00000308165
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 13102 - protein, 472 aa, Homo sapiens; identical to SEQ ID NO: 13101
  Payload ID: 2554
  Gene Symbol: CD36
  Gene Name: CD36 molecule (thrombospondin receptor)
  Uniprot ID: P16671
  ENSP ID: ENSP00000378268

SEQ ID NO: 13103 - protein, 463 aa, Homo sapiens
  Payload ID: 2554
  Gene Symbol: CD36
  Gene Name: CD36 molecule (thrombospondin receptor)
  ENSP ID: ENSP00000392298
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISY

SEQ ID NO: 13104 - protein, 99 aa, Homo sapiens
  Payload ID: 2554
  Gene Symbol: CD36
  Gene Name: CD36 molecule (thrombospondin receptor)
  ENSP ID: ENSP00000396258
MGCDRNCGLIAGAVIGAVLAVFGGILMPVGDLLIQKTIKKQVVLEEGTIAFKNWVKTGTEVYRQFWIFDVQNPQEVMMNSSCIPYLSKSICSNDPQFTY

SEQ ID NO: 13105 - protein, 93 aa, Homo sapiens
  Payload ID: 2554
  Gene Symbol: CD36
  Gene Name: CD36 molecule (thrombospondin receptor)
  ENSP ID: ENSP00000398760
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTY

SEQ ID NO: 13106 - protein, 472 aa, Homo sapiens; identical to SEQ ID NO: 13101
  Payload ID: 2554
  Gene Symbol: CD36
  Gene Name: CD36 molecule (thrombospondin receptor)
  Uniprot ID: P16671
  ENSP ID: ENSP00000399421

SEQ ID NO: 13107 - protein, 433 aa, Homo sapiens
  Payload ID: 2554
  Gene Symbol: CD36
  Gene Name: CD36 molecule (thrombospondin receptor)
  Uniprot ID: P16671
  ENSP ID: ENSP00000401863
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 13108 - protein, 203 aa, Homo sapiens
  Payload ID: 2554
  Gene Symbol: CD36
  Gene Name: CD36 molecule (thrombospondin receptor)
  ENSP ID: ENSP00000407690
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYP

SEQ ID NO: 13109 - protein, 93 aa, Homo sapiens; identical to SEQ ID NO: 13105
  Payload ID: 2554
  Gene Symbol: CD36
  Gene Name: CD36 molecule (thrombospondin receptor)
  ENSP ID: ENSP00000409762

SEQ ID NO: 13110 - protein, 143 aa, Homo sapiens
  Payload ID: 2554
  Gene Symbol: CD36
  Gene Name: CD36 molecule (thrombospondin receptor)
  ENSP ID: ENSP00000410371
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVA

SEQ ID NO: 13111 - protein, 472 aa, Homo sapiens; identical to SEQ ID NO: 13101
  Payload ID: 2554
  Gene Symbol: CD36
  Gene Name: CD36 molecule (thrombospondin receptor)
  Uniprot ID: P16671
  ENSP ID: ENSP00000411411

SEQ ID NO: 13112 - protein, 472 aa, Homo sapiens; identical to SEQ ID NO: 13101
  Payload ID: 2554
  Gene Symbol: CD36
  Gene Name: CD36 molecule (thrombospondin receptor)
  Uniprot ID: P16671
  ENSP ID: ENSP00000415743

SEQ ID NO: 13113 - protein, 148 aa, Homo sapiens
  Payload ID: 2554
  Gene Symbol: CD36
  Gene Name: CD36 molecule (thrombospondin receptor)
  ENSP ID: ENSP00000416388
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHI

SEQ ID NO: 13114 - protein, 396 aa, Homo sapiens
  Payload ID: 2554
  Gene Symbol: CD36
  Gene Name: CD36 molecule (thrombospondin receptor)
  ENSP ID: ENSP00000431296
MMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 13115 - protein, 65 aa, Homo sapiens
  Payload ID: 2554
  Gene Symbol: CD36
  Gene Name: CD36 molecule (thrombospondin receptor)
  ENSP ID: ENSP00000433659
MGCDRNCGLIAGAVIGAVLAVFGGILMPVGDLLIQKTIKKQVVLEEGTIAFKNWVKTGTEVYRQF

SEQ ID NO: 13116 - protein, 66 aa, Homo sapiens
  Payload ID: 2554
  Gene Symbol: CD36
  Gene Name: CD36 molecule (thrombospondin receptor)
  ENSP ID: ENSP00000435698
  MOD_RES (1)..(1): Any amino acid
XNYIVPILWLNETGTIGDEKANMFRSQVTGKINLLGLIEMILLSVGVVMFVAFMISYCACRSKTIK

SEQ ID NO: 13117 - protein, 412 aa, Homo sapiens
  Payload ID: 2554
  Gene Symbol: CD36
  Gene Name: CD36 molecule (thrombospondin receptor)
  Uniprot ID: P16671
  ENSP ID: ENSP00000439543
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 13118 - protein, 288 aa, Homo sapiens
  Payload ID: 2554
  Gene Symbol: CD36
  Gene Name: CD36 molecule (thrombospondin receptor)
  Uniprot ID: P16671
  ENSP ID: ENSP00000441956
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRETCVHFTSSFSVCKS

SEQ ID NO: 13119 - protein, 281 aa, Homo sapiens
  Payload ID: 2555
  Gene Symbol: CD37
  Gene Name: CD37 molecule
  Uniprot ID: P11049
  ENSP ID: ENSP00000325708
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 13120 - protein, 156 aa, Homo sapiens
  Payload ID: 2555
  Gene Symbol: CD37
  Gene Name: CD37 molecule
  ENSP ID: ENSP00000375732
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQKDTPTWTKGDRHKQLQRETHGKKREQEKEIDALKEETETYEP

SEQ ID NO: 13121 - protein, 213 aa, Homo sapiens
  Payload ID: 2555
  Gene Symbol: CD37
  Gene Name: CD37 molecule
  Uniprot ID: P11049
  ENSP ID: ENSP00000413151
MGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 13122 - protein, 270 aa, Homo sapiens
  Payload ID: 2555
  Gene Symbol: CD37
  Gene Name: CD37 molecule
  ENSP ID: ENSP00000441037
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLEVIWPRPHPRSALNP

SEQ ID NO: 13123 - protein, 160 aa, Homo sapiens
  Payload ID: 2555
  Gene Symbol: CD37
  Gene Name: CD37 molecule
  ENSP ID: ENSP00000470260
MSAQESCLSLIKYFLFVFNLFFFVLGSLIFCFGIWILIDKTSFVSFVGRLQAPIHCSPEASWSLSLLPANGVVHTNNNDHESHFSSTSYLSGLVAGLAFVPLQIWSKVLAISGIFTMGIALLGCVGALKELRCLLGLYFGMLLLLFATQITLGILISTQR

SEQ ID NO: 13124 - protein, 202 aa, Homo sapiens
  Payload ID: 2555
  Gene Symbol: CD37
  Gene Name: CD37 molecule
  Uniprot ID: P11049
  ENSP ID: ENSP00000470394
MGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLEVIWPRPHPRSALNP

SEQ ID NO: 13125 - protein, 254 aa, Homo sapiens
  Payload ID: 2555
  Gene Symbol: CD37
  Gene Name: CD37 molecule
  ENSP ID: ENSP00000470683
  MOD_RES (1)..(1): Any amino acid
XAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLEMTVMVLSVQLQRRALRRKCEPHVPGAGDSSPGPSLIADGGGGHSGSLWGGWGMAGACPNWGDKAPQGKLPMALGLWPLWVQDEDQPDTGSAGAELEEAQLEAEAEGEDR

SEQ ID NO: 13126 - protein, 26 aa, Homo sapiens
  Payload ID: 2555
  Gene Symbol: CD37
  Gene Name: CD37 molecule
  ENSP ID: ENSP00000471078
MGIALLGCVGALKELRCLLGLYFGML

SEQ ID NO: 13127 - protein, 121 aa, Homo sapiens
  Payload ID: 2555
  Gene Symbol: CD37
  Gene Name: CD37 molecule
  ENSP ID: ENSP00000471902
MSAQESCLSLIKYFLFVFNLFFFVLGSLIFCFGIWILIDKTSFVSFAWPSCLCRSGPKSWPSQESSPWASPSWVVWGPSRSSAASWACILGCCCSCLPHRSPWESSSPLSGPSWSEACGTS

SEQ ID NO: 13128 - protein, 300 aa, Homo sapiens
  Payload ID: 2556
  Gene Symbol: CD38
  Gene Name: CD38 molecule
  Uniprot ID: P28907
  ENSP ID: ENSP00000226279
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 13129 - protein, 151 aa, Homo sapiens
  Payload ID: 2556
  Gene Symbol: CD38
  Gene Name: CD38 molecule
  ENSP ID: ENSP00000423047
QPLMKLGTQTVPCNKILLWSRIKDLAHQFTQVQRDMFTLEDTLLGYLADDLTWCEINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELE

SEQ ID NO: 13130 - protein, 122 aa, Homo sapiens
  Payload ID: 2556
  Gene Symbol: CD38
  Gene Name: CD38 molecule
  Uniprot ID: P28907
  ENSP ID: ENSP00000427277
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKK

SEQ ID NO: 13131 - protein, 171 aa, Homo sapiens
  Payload ID: 2557
  Gene Symbol: CD3D
  Gene Name: CD3d molecule, delta (CD3-TCR complex)
  Uniprot ID: P04234
  ENSP ID: ENSP00000300692
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 13132 - protein, 127 aa, Homo sapiens
  Payload ID: 2557
  Gene Symbol: CD3D
  Gene Name: CD3d molecule, delta (CD3-TCR complex)
  Uniprot ID: P04234
  ENSP ID: ENSP00000376622
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 13133 - protein, 132 aa, Homo sapiens
  Payload ID: 2557
  Gene Symbol: CD3D
  Gene Name: CD3d molecule, delta (CD3-TCR complex)
  ENSP ID: ENSP00000434794
  MOD_RES (1)..(1): Any amino acid
XSRCFSGPCSPYSSSVVWIHFQEVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 13134 - protein, 98 aa, Homo sapiens
  Payload ID: 2557
  Gene Symbol: CD3D
  Gene Name: CD3d molecule, delta (CD3-TCR complex)
  ENSP ID: ENSP00000437335
MEHSTFLSGLVLATLLSQVCQSCVELDPATVAGIIVTDVIATLLLALGVFCFAGHETGRLSGAADTQALLRNDQVYQPLRDRDDAQYSHLGGNWARNK

SEQ ID NO: 13135 - protein, 207 aa, Homo sapiens
  Payload ID: 2558
  Gene Symbol: CD3E
  Gene Name: CD3e molecule, epsilon (CD3-TCR complex)
  Uniprot ID: P07766
  ENSP ID: ENSP00000354566
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 13136 - protein, 201 aa, Homo sapiens
  Payload ID: 2558
  Gene Symbol: CD3E
  Gene Name: CD3e molecule, epsilon (CD3-TCR complex)
  ENSP ID: ENSP00000433975
MQSGTHWRVLGLCLLSVGVWGQDGNEEMAYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 13137 - protein, 510 aa, Homo sapiens
  Payload ID: 2559
  Gene Symbol: CD3EAP
  Gene Name: CD3e molecule, epsilon associated protein
  Uniprot ID: O15446
  ENSP ID: ENSP00000310966
MEEPQAGDAARFSCPPNFTAKPPASESPRFSLEALTGPDTELWLIQAPADFAPECFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 13138 - protein, 512 aa, Homo sapiens
  Payload ID: 2559
  Gene Symbol: CD3EAP
  Gene Name: CD3e molecule, epsilon associated protein
  Uniprot ID: O15446
  ENSP ID: ENSP00000465099
MEEPQAGGEDAARFSCPPNFTAKPPASESPRFSLEALTGPDTELWLIQAPADFAPECFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 13139 - protein, 67 aa, Homo sapiens
  Payload ID: 2559
  Gene Symbol: CD3EAP
  Gene Name: CD3e molecule, epsilon associated protein
  ENSP ID: ENSP00000466503
  MOD_RES (1)..(1): Any amino acid
XEEPQAGASMGGMCLSLAPRSSRANWQASGTAIESSAAVPKLEKRPCWPPQRRQEVDSPVPQPPRAP

SEQ ID NO: 13140 - protein, 39 aa, Homo sapiens
  Payload ID: 2559
  Gene Symbol: CD3EAP
  Gene Name: CD3e molecule, epsilon associated protein
  ENSP ID: ENSP00000467771
MQVTEAPVTQEAVNGHGALEVDMALGSPEMDVRKKKKKK

SEQ ID NO: 13141 - protein, 40 aa, Homo sapiens
  Payload ID: 2560
  Gene Symbol: CD3G
  Gene Name: CD3g molecule, gamma (CD3-TCR complex)
  ENSP ID: ENSP00000292144
MEQGKGLAVLILAIILLQGTLAQSIKGRRNGFFLYSDSEY

SEQ ID NO: 13142 - protein, 78 aa, Homo sapiens
  Payload ID: 2560
  Gene Symbol: CD3G
  Gene Name: CD3g molecule, gamma (CD3-TCR complex)
  ENSP ID: ENSP00000376621
MIGFLTEDKKKWNLGSNAKDPRGMYQCKGSQNKSKPLQVYYRTSDKQTLLPNDQLYQPLKDREDDQYSHLQGNQLRRN

SEQ ID NO: 13143 - protein, 182 aa, Homo sapiens
  Payload ID: 2560
  Gene Symbol: CD3G
  Gene Name: CD3g molecule, gamma (CD3-TCR complex)
  Uniprot ID: P09693
  ENSP ID: ENSP00000431445
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 13144 - protein, 458 aa, Homo sapiens
  Payload ID: 2561
  Gene Symbol: CD4
  Gene Name: CD4 molecule
  Uniprot ID: P01730
  ENSP ID: ENSP00000011653
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 13145 - protein, 45 aa, Homo sapiens
  Payload ID: 2561
  Gene Symbol: CD4
  Gene Name: CD4 molecule
  ENSP ID: ENSP00000440720
MNRGVPFRHLLLVLQLALLPAATQGKKVVLGKKGDTVELTCTASQ

SEQ ID NO: 13146 - protein, 148 aa, Homo sapiens
  Payload ID: 2561
  Gene Symbol: CD4
  Gene Name: CD4 molecule
  ENSP ID: ENSP00000445167
MNRGVPFRHLLLVLQLGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLG

SEQ ID NO: 13147 - protein, 240 aa, Homo sapiens
  Payload ID: 2562
  Gene Symbol: CD40LG
  Gene Name: CD40 ligand
  ENSP ID: ENSP00000359662
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 13148 - protein, 261 aa, Homo sapiens
  Payload ID: 2562
  Gene Symbol: CD40LG
  Gene Name: CD40 ligand
  Uniprot ID: P29965
  ENSP ID: ENSP00000359663
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 13149 - protein, 203 aa, Homo sapiens
  Payload ID: 2563
  Gene Symbol: CD40
  Gene Name: CD40 molecule, TNF receptor superfamily member 5
  Uniprot ID: P25942
  ENSP ID: ENSP00000361350
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 13150 - protein, 277 aa, Homo sapiens
  Payload ID: 2563
  Gene Symbol: CD40
  Gene Name: CD40 molecule, TNF receptor superfamily member 5
  Uniprot ID: P25942
  ENSP ID: ENSP00000361359
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 13151 - protein, 159 aa, Homo sapiens
  Payload ID: 2563
  Gene Symbol: CD40
  Gene Name: CD40 molecule, TNF receptor superfamily member 5
  ENSP ID: ENSP00000434825
  MOD_RES (1)..(1): Any amino acid
XRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIAVRPKTWLCNRQAQTRLMLSVVPRIG

SEQ ID NO: 13152 - protein, 151 aa, Homo sapiens
  Payload ID: 2563
  Gene Symbol: CD40
  Gene Name: CD40 molecule, TNF receptor superfamily member 5
  ENSP ID: ENSP00000484074
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIDICQPHFPKDRGLNLLM

SEQ ID NO: 13153 - protein, 361 aa, Homo sapiens
  Payload ID: 2564
  Gene Symbol: CD44
  Gene Name: CD44 molecule (Indian blood group)
  Uniprot ID: P16070
  ENSP ID: ENSP00000263398
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13154 - protein, 232 aa, Homo sapiens
  Payload ID: 2564
  Gene Symbol: CD44
  Gene Name: CD44 molecule (Indian blood group)
  ENSP ID: ENSP00000278385
PEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLV

SEQ ID NO: 13155 - protein, 139 aa, Homo sapiens
  Payload ID: 2564
  Gene Symbol: CD44
  Gene Name: CD44 molecule (Indian blood group)
  Uniprot ID: P16070
  ENSP ID: ENSP00000278386
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 13156 - protein, 287 aa, Homo sapiens
  Payload ID: 2564
  Gene Symbol: CD44
  Gene Name: CD44 molecule (Indian blood group)
  ENSP ID: ENSP00000279452
RYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMK

SEQ ID NO: 13157 - protein, 340 aa, Homo sapiens
  Payload ID: 2564
  Gene Symbol: CD44
  Gene Name: CD44 molecule (Indian blood group)
  Uniprot ID: P16070
  ENSP ID: ENSP00000309732
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13158 - protein, 699 aa, Homo sapiens
  Payload ID: 2564
  Gene Symbol: CD44
  Gene Name: CD44 molecule (Indian blood group)
  Uniprot ID: P16070
  ENSP ID: ENSP00000389830
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13159 - protein, 493 aa, Homo sapiens
  Payload ID: 2564
  Gene Symbol: CD44
  Gene Name: CD44 molecule (Indian blood group)
  Uniprot ID: P16070
  ENSP ID: ENSP00000392331
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13160 - protein, 80 aa, Homo sapiens
  Payload ID: 2564
  Gene Symbol: CD44
  Gene Name: CD44 molecule (Indian blood group)
  ENSP ID: ENSP00000395953
MDKFWWHAAWGLCLVPLSLAQIDLNITCRFAGVFHVEKNGRYSISRTEAADLCKAFNSTLPTMAQMEKALSIGFETCSST

SEQ ID NO: 13161 - protein, 294 aa, Homo sapiens
  Payload ID: 2564
  Gene Symbol: CD44
  Gene Name: CD44 molecule (Indian blood group)
  ENSP ID: ENSP00000398099
  MOD_RES (1)..(1): Any amino acid
XDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRS

SEQ ID NO: 13162 - protein, 742 aa, Homo sapiens
  Payload ID: 2564
  Gene Symbol: CD44
  Gene Name: CD44 molecule (Indian blood group)
  Uniprot ID: P16070
  ENSP ID: ENSP00000398632
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13163 - protein, 429 aa, Homo sapiens
  Payload ID: 2564
  Gene Symbol: CD44
  Gene Name: CD44 molecule (Indian blood group)
  Uniprot ID: P16070
  ENSP ID: ENSP00000404447
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13164 - protein, 195 aa, Homo sapiens
  Payload ID: 2564
  Gene Symbol: CD44
  Gene Name: CD44 molecule (Indian blood group)
  ENSP ID: ENSP00000431860
RNGTTAYEGNWNPEAHPPLIHHEHHEEEETPHSTSTIQATPSSTTEETATQKEQWFGNRWHEGYRQTPKEDSHSTTGTADMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVT

SEQ ID NO: 13165 - protein, 249 aa, Homo sapiens
  Payload ID: 2564
  Gene Symbol: CD44
  Gene Name: CD44 molecule (Indian blood group)
  ENSP ID: ENSP00000432405
IDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTASAHTSHPMQGRTTPSPEDSSWTDFFNPISHPMGRGHQAGRRMGNSL

SEQ ID NO: 13166 - protein, 206 aa, Homo sapiens
  Payload ID: 2564
  Gene Symbol: CD44
  Gene Name: CD44 molecule (Indian blood group)
  ENSP ID: ENSP00000432704
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 13167 - protein, 229 aa, Homo sapiens
  Payload ID: 2564
  Gene Symbol: CD44
  Gene Name: CD44 molecule (Indian blood group)
  ENSP ID: ENSP00000432718
  MOD_RES (1)..(1): Any amino acid
XQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATISTTPRAFDHTKQNQDWTQWNPSHSNPEVLLQTTTRMTDVDRNGTTAYEGNWNPEAHPPLIHHEHHEEEE

SEQ ID NO: 13168 - protein, 195 aa, Homo sapiens
  Payload ID: 2564
  Gene Symbol: CD44
  Gene Name: CD44 molecule (Indian blood group)
  ENSP ID: ENSP00000433189
  MOD_RES (1)..(1): Any amino acid
XFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATKQSNSQSFSTSHEGLEEDKDHPTTSTLTSSNRNDVTGGRRDPNHSEGSTTLL

SEQ ID NO: 13169 - protein, 191 aa, Homo sapiens
  Payload ID: 2564
  Gene Symbol: CD44
  Gene Name: CD44 molecule (Indian blood group)
  ENSP ID: ENSP00000434418
  MOD_RES (1)..(1): Any amino acid
XSTTPRAFDHTKQNQDWTQWNPSHSNPEVLLQTTTRMTVQATPSSTTEETATQKEQWFGNRWHEGYRQTPKEDSHSTTGTAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSSKD

SEQ ID NO: 13170 - protein, 240 aa, Homo sapiens
  Payload ID: 2564
  Gene Symbol: CD44
  Gene Name: CD44 molecule (Indian blood group)
  ENSP ID: ENSP00000434465
DLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGDRNDVTGGRRDPNHSEGSTTLLEGYTSHYPHTKESRTFIPVTSAKTGSFGVTAVTVGDSNSNVNRSLSGDQ

SEQ ID NO: 13171 - protein, 181 aa, Homo sapiens
  Payload ID: 2564
  Gene Symbol: CD44
  Gene Name: CD44 molecule (Indian blood group)
  ENSP ID: ENSP00000434530
  MOD_RES (1)..(1): Any amino acid
XRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGDMDSSHSITLQPTANPNTGLVEDLDRTGPLSMTT

SEQ ID NO: 13172 - protein, 82 aa, Homo sapiens
  Payload ID: 2564
  Gene Symbol: CD44
  Gene Name: CD44 molecule (Indian blood group)
  ENSP ID: ENSP00000434920
SKHNLWSYKDTPNSRCGQKKKLVINSGNGAVEDRKPSGLNGEASKSQEMVHLVNKESSETPDQFMTADETRNLQNVDMKIGV

SEQ ID NO: 13173 - protein, 193 aa, Homo sapiens
  Payload ID: 2564
  Gene Symbol: CD44
  Gene Name: CD44 molecule (Indian blood group)
  ENSP ID: ENSP00000435321
IYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHT

SEQ ID NO: 13174 - protein, 78 aa, Homo sapiens
  Payload ID: 2564
  Gene Symbol: CD44
  Gene Name: CD44 molecule (Indian blood group)
  ENSP ID: ENSP00000435377
MDKFWWHAAWGLCLVPLSLAQIDLNITCRFAGVFHVEKNGRYSISRTEAADLCKAFNSTLPTMAQMEKALSIGFETCR

SEQ ID NO: 13175 - protein, 118 aa, Homo sapiens
  Payload ID: 2564
  Gene Symbol: CD44
  Gene Name: CD44 molecule (Indian blood group)
  ENSP ID: ENSP00000436451
  MOD_RES (1)..(1): Any amino acid
XPDEDSPWITDSTDRIPATSWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHH

SEQ ID NO: 13176 - protein, 249 aa, Homo sapiens
  Payload ID: 2564
  Gene Symbol: CD44
  Gene Name: CD44 molecule (Indian blood group)
  ENSP ID: ENSP00000436549
EDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSSK

SEQ ID NO: 13177 - protein, 243 aa, Homo sapiens
  Payload ID: 2564
  Gene Symbol: CD44
  Gene Name: CD44 molecule (Indian blood group)
  ENSP ID: ENSP00000436623
  MOD_RES (1)..(1): Any amino acid
XDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSSKDY

SEQ ID NO: 13178 - protein, 186 aa, Homo sapiens
  Payload ID: 2564
  Gene Symbol: CD44
  Gene Name: CD44 molecule (Indian blood group)
  ENSP ID: ENSP00000436980
RTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTRDQDTFHPSGGSHTTHGSESDGHSHGSQEGGANTTSGPIRTPQIPEWLIILASLLALALILAVCIAVNSRRRCGQKKKLVINS

SEQ ID NO: 13179 - protein, 399 aa, Homo sapiens
  Payload ID: 2565
  Gene Symbol: CD46
  Gene Name: CD46 molecule, complement regulatory protein
  Uniprot ID: P15529
  ENSP ID: ENSP00000313875
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 13180 - protein, 349 aa, Homo sapiens
  Payload ID: 2565
  Gene Symbol: CD46
  Gene Name: CD46 molecule, complement regulatory protein
  Uniprot ID: P15529
  ENSP ID: ENSP00000314664
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIGKQMVELNMPLTRLNQPLQQSREAE

SEQ ID NO: 13181 - protein, 384 aa, Homo sapiens
  Payload ID: 2565
  Gene Symbol: CD46
  Gene Name: CD46 molecule, complement regulatory protein
  Uniprot ID: P15529
  ENSP ID: ENSP00000346912
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 13182 - protein, 369 aa, Homo sapiens
  Payload ID: 2565
  Gene Symbol: CD46
  Gene Name: CD46 molecule, complement regulatory protein
  Uniprot ID: P15529
  ENSP ID: ENSP00000350346
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 13183 - protein, 392 aa, Homo sapiens [sequence omitted]

SEQ ID NO: 13184 - protein, 355 aa, Homo sapiens
  Payload ID: 2565
  Gene Symbol: CD46
  Gene Name: CD46 molecule, complement regulatory protein
  Uniprot ID: P15529
  ENSP ID: ENSP00000353342
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGYPKPEEGILDSLDVWVIAVIVIAIVVGVAVICVVPYRYLQRRKKKGKADGGAEYATYQTKSTTPAEQRG

SEQ ID NO: 13185 - protein, 362 aa, Homo sapiens
  Payload ID: 2565
  Gene Symbol: CD46
  Gene Name: CD46 molecule, complement regulatory protein
  Uniprot ID: P15529
  ENSP ID: ENSP00000356008
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGTYLTDETHREVKFTSL

SEQ ID NO: 13186 - protein, 377 aa, Homo sapiens
  Payload ID: 2565
  Gene Symbol: CD46
  Gene Name: CD46 molecule, complement regulatory protein
  Uniprot ID: P15529
  ENSP ID: ENSP00000356009
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 13187 - protein, 336 aa, Homo sapiens
  Payload ID: 2565
  Gene Symbol: CD46
  Gene Name: CD46 molecule, complement regulatory protein
  Uniprot ID: P15529
  ENSP ID: ENSP00000356014
MEPPGRRECPFPSWRFPGLLLAAMVLLLYSFSGETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 13188 - protein, 370 aa, Homo sapiens
  Payload ID: 2565
  Gene Symbol: CD46
  Gene Name: CD46 molecule, complement regulatory protein
  Uniprot ID: P15529
  ENSP ID: ENSP00000418471
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGYPKPEEGILDSLDVWVIAVIVIAIVVGVAVICVVPYRYLQRRKKKGKADGGAEYATYQTKSTTPAEQRG

SEQ ID NO: 13189 - protein, 78 aa, Homo sapiens
  Payload ID: 2565
  Gene Symbol: CD46
  Gene Name: CD46 molecule, complement regulatory protein
  ENSP ID: ENSP00000473449
  MOD_RES (1)..(1): Any amino acid
XPPVSNYPGYPKPEEGILDSLDVWVIAVIVIAIVVGVAVICVVPYRYLQRRKKKGKADGGAEYATYQTKSTTPAEQRG

SEQ ID NO: 13190 - protein, 305 aa, Homo sapiens
  Payload ID: 2566
  Gene Symbol: CD47
  Gene Name: CD47 molecule
  Uniprot ID: Q08722
  ENSP ID: ENSP00000347512
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRNN

SEQ ID NO: 13191 - protein, 323 aa, Homo sapiens
  Payload ID: 2566
  Gene Symbol: CD47
  Gene Name: CD47 molecule
  Uniprot ID: Q08722
  ENSP ID: ENSP00000355361
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 13192 - protein, 86 aa, Homo sapiens
  Payload ID: 2566
  Gene Symbol: CD47
  Gene Name: CD47 molecule
  ENSP ID: ENSP00000381309
  MOD_RES (1)..(1): Any amino acid
XWTESLYCGVYTNAWPSSDFRFEYLSSSTITWTSLYEICGVQRDTYSQLKGKKRQASNQKTIQPPRKAVEEPLNAFKESKGMMNDE

SEQ ID NO: 13193 - protein, 109 aa, Homo sapiens
  Payload ID: 2566
  Gene Symbol: CD47
  Gene Name: CD47 molecule
  ENSP ID: ENSP00000430843
  MOD_RES (1)..(1): Any amino acid
XKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNE

SEQ ID NO: 13194 - protein, 169 aa, Homo sapiens
  Payload ID: 2567
  Gene Symbol: CD48
  Gene Name: CD48 molecule
  Uniprot ID: P09326
  ENSP ID: ENSP00000357024
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLGESGEPKSKSPLQWPQMDHCRASWEAWGTLGEEERKTSGQV

SEQ ID NO: 13195 - protein, 243 aa, Homo sapiens
  Payload ID: 2567
  Gene Symbol: CD48
  Gene Name: CD48 molecule
  Uniprot ID: P09326
  ENSP ID: ENSP00000357025
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 13196 - protein, 252 aa, Homo sapiens
  Payload ID: 2567
  Gene Symbol: CD48
  Gene Name: CD48 molecule
  ENSP ID: ENSP00000484431
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLGKKDPWELRGAQGNWSCFEQRKAGGPIQPPCTVWW

SEQ ID NO: 13197 - protein, 495 aa, Homo sapiens
  Payload ID: 2568
  Gene Symbol: CD5
  Gene Name: CD5 molecule
  Uniprot ID: P06127
  ENSP ID: ENSP00000342681
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 13198 - protein, 165 aa, Homo sapiens
  Payload ID: 2568
  Gene Symbol: CD5
  Gene Name: CD5 molecule
  ENSP ID: ENSP00000440899
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAMRPRTRPRTW

SEQ ID NO: 13199 - protein, 347 aa, Homo sapiens
  Payload ID: 2569
  Gene Symbol: CD5L
  Gene Name: CD5 molecule-like
  Uniprot ID: O43866
  ENSP ID: ENSP00000357156
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 13200 - protein, 61 aa, Homo sapiens
  Payload ID: 2570
  Gene Symbol: CD52
  Gene Name: CD52 molecule
  Uniprot ID: P31358
  ENSP ID: ENSP00000363330
MKRFLFLLLTISLLVMVQIQTGLSGQNDTSQTSSPSASSNISGGIFLFFVANAIIHLFCFS

SEQ ID NO: 13201 - protein, 219 aa, Homo sapiens
  Payload ID: 2571
  Gene Symbol: CD53
  Gene Name: CD53 molecule
  Uniprot ID: P19397
  ENSP ID: ENSP00000271324
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 13202 - protein, 440 aa, Homo sapiens
  Payload ID: 2572
  Gene Symbol: CD55
  Gene Name: CD55 molecule, decay accelerating  factor for complement (Cromer blood group)
  Uniprot ID: P08174
  ENSP ID: ENSP00000316333
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 13203 - protein, 326 aa, Homo sapiens
  Payload ID: 2572
  Gene Symbol: CD55
  Gene Name: CD55 molecule, decay accelerating  factor for complement (Cromer blood group)
  ENSP ID: ENSP00000340631
  MOD_RES (1)..(1): Any amino acid
XAALPLLGELPRLLLLVLLCLPAVWESSRVEHTMLQTCMSSLSGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKT

SEQ ID NO: 13204 - protein, 444 aa, Homo sapiens
  Payload ID: 2572
  Gene Symbol: CD55
  Gene Name: CD55 molecule, decay accelerating  factor for complement (Cromer blood group)
  ENSP ID: ENSP00000356030
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRCVPRHPAKFLKFIFCRDRIFLCCPGWFQTPGRKRFFRPPKTLRL

SEQ ID NO: 13205 - protein, 381 aa, Homo sapiens
  Payload ID: 2572
  Gene Symbol: CD55
  Gene Name: CD55 molecule, decay accelerating  factor for complement (Cromer blood group)
  Uniprot ID: P08174
  ENSP ID: ENSP00000356031
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 13206 - protein, 550 aa, Homo sapiens
  Payload ID: 2572
  Gene Symbol: CD55
  Gene Name: CD55 molecule, decay accelerating  factor for complement (Cromer blood group)
  ENSP ID: ENSP00000356034
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAARKSTNVHSPVTNGLKSTQRFPSAHITATRSTPVSRTTKHFHETTPNKGSGTTSGTTRLLSGHTCFTLTGLLGTLVTMGLLT

SEQ ID NO: 13207 - protein, 317 aa, Homo sapiens
  Payload ID: 2572
  Gene Symbol: CD55
  Gene Name: CD55 molecule, decay accelerating  factor for complement (Cromer blood group)
  ENSP ID: ENSP00000375788
MTVARPSVPAALPLLGELPRLLLLVLLCLPAVWGDCGLPPDVPNAQPALEGRTSFPEDTVITYKCEESFVKIPGEKDSVICLKGSQWSDIEEFCNQKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 13208 - protein, 240 aa, Homo sapiens
  Payload ID: 2573
  Gene Symbol: CD58
  Gene Name: CD58 molecule
  ENSP ID: ENSP00000358499
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGMYAF

SEQ ID NO: 13209 - protein, 250 aa, Homo sapiens
  Payload ID: 2573
  Gene Symbol: CD58
  Gene Name: CD58 molecule
  Uniprot ID: P19256
  ENSP ID: ENSP00000358501
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 13210 - protein, 248 aa, Homo sapiens
  Payload ID: 2573
  Gene Symbol: CD58
  Gene Name: CD58 molecule
  Uniprot ID: P19256
  ENSP ID: ENSP00000409080
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 13211 - protein, 237 aa, Homo sapiens
  Payload ID: 2573
  Gene Symbol: CD58
  Gene Name: CD58 molecule
  Uniprot ID: P19256
  ENSP ID: ENSP00000432773
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNVL

SEQ ID NO: 13212 - protein, 131 aa, Homo sapiens
  Payload ID: 2573
  Gene Symbol: CD58
  Gene Name: CD58 molecule
  ENSP ID: ENSP00000433648
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLGHSRHRYALIPIPLAVITTCIVLYMNGILKCDRKPDRT

SEQ ID NO: 13213 - protein, 128 aa, Homo sapiens
  Payload ID: 2574
  Gene Symbol: CD59
  Gene Name: CD59 molecule, complement regulatory protein
  Uniprot ID: P13987
  ENSP ID: ENSP00000340210
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 13214 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000379191

SEQ ID NO: 13215 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000402425

SEQ ID NO: 13216 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000403511

SEQ ID NO: 13217 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000404822

SEQ ID NO: 13218 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000410182

SEQ ID NO: 13219 - protein, 130 aa, Homo sapiens
  Payload ID: 2574
  Gene Symbol: CD59
  Gene Name: CD59 molecule, complement regulatory protein
  ENSP ID: ENSP00000432362
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENDTFLKALKDEKLQGLKTKQPGKKSASLS

SEQ ID NO: 13220 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000432942

SEQ ID NO: 13221 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000434617

SEQ ID NO: 13222 - protein, 128 aa, Homo sapiens; identical to SEQ ID NO: 13213
  Payload ID: 2574
  Gene Symbol: CD59
  Gene Name: CD59 molecule, complement regulatory protein
  Uniprot ID: P13987
  ENSP ID: ENSP00000435179

SEQ ID NO: 13223 - protein, 52 aa, Homo sapiens
  Payload ID: 2574
  Gene Symbol: CD59
  Gene Name: CD59 molecule, complement regulatory protein
  ENSP ID: ENSP00000436497
  MOD_RES (1)..(1): Any amino acid
XRLRENELTYYCCKKDLCNFNEQLENGGTSLSEKTVLLLVTPFLAAAWSLHP

SEQ ID NO: 13224 - protein, 119 aa, Homo sapiens
  Payload ID: 2574
  Gene Symbol: CD59
  Gene Name: CD59 molecule, complement regulatory protein
  ENSP ID: ENSP00000436737
MGIQGGSVLFGLLLVLAVFCHSGHSLQCYNCPNPTADCKTAVNCSSDFDACLITKAELGYHYVAQAGRRQSSHFSLLKCWDYRCEPSHWPHCPYFNWGYKCITSVGSLSIAISTTSQPA

SEQ ID NO: 13225 - protein, 108 aa, Homo sapiens
  Payload ID: 2574
  Gene Symbol: CD59
  Gene Name: CD59 molecule, complement regulatory protein
  ENSP ID: ENSP00000437122
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGSEPGA

SEQ ID NO: 13226 - protein, 668 aa, Homo sapiens
  Payload ID: 2575
  Gene Symbol: CD6
  Gene Name: CD6 molecule
  Uniprot ID: P30203
  ENSP ID: ENSP00000323280
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 13227 - protein, 468 aa, Homo sapiens
  Payload ID: 2575
  Gene Symbol: CD6
  Gene Name: CD6 molecule
  ENSP ID: ENSP00000340334
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEGPGPAP

SEQ ID NO: 13228 - protein, 601 aa, Homo sapiens
  Payload ID: 2575
  Gene Symbol: CD6
  Gene Name: CD6 molecule
  Uniprot ID: P30203
  ENSP ID: ENSP00000340628
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 13229 - protein, 592 aa, Homo sapiens
  Payload ID: 2575
  Gene Symbol: CD6
  Gene Name: CD6 molecule
  Uniprot ID: P30203
  ENSP ID: ENSP00000390676
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEDSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSGSPSPQPDSTDNDDYDDISAA

SEQ ID NO: 13230 - protein, 422 aa, Homo sapiens
  Payload ID: 2575
  Gene Symbol: CD6
  Gene Name: CD6 molecule
  ENSP ID: ENSP00000410638
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSASRSLHNLSTPEVPASVQTVTIESSVTVKIENKESRELMLLIPSIVLGILLLGSLIFIAFILLRIKGKYVFMLPIQVQAPPPEDSDSGSDSDYEHYDFSAQPPVALTTFYNSQRHRVTDEEVQQSRFQMPPLEEGLEELHASHIPTANPGHCITDPPSLGPQ

SEQ ID NO: 13231 - protein, 278 aa, Homo sapiens
  Payload ID: 2575
  Gene Symbol: CD6
  Gene Name: CD6 molecule
  ENSP ID: ENSP00000440055
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSESSVTVKIENKESRELML

SEQ ID NO: 13232 - protein, 185 aa, Homo sapiens
  Payload ID: 2575
  Gene Symbol: CD6
  Gene Name: CD6 molecule
  ENSP ID: ENSP00000443747
  MOD_RES (1)..(1): Any amino acid
XNRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSASRSLHNLSTPEVPASVQTVTIESSVTVKIENKESRELMLLIPSIVLGILLLGSLIFIAFILLRIKGKYALPVMVNHQHLP

SEQ ID NO: 13233 - protein, 38 aa, Homo sapiens
  Payload ID: 2575
  Gene Symbol: CD6
  Gene Name: CD6 molecule
  ENSP ID: ENSP00000443748
MWLFFGITGLLTAALSGCTVAKWIQLLGEICCFAGMGF

SEQ ID NO: 13234 - protein, 238 aa, Homo sapiens
  Payload ID: 2576
  Gene Symbol: CD63
  Gene Name: CD63 molecule
  Uniprot ID: P08962
  ENSP ID: ENSP00000257857
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 13235 - protein, 238 aa, Homo sapiens; identical to SEQ ID NO: 13234
  Payload ID: 2576
  Gene Symbol: CD63
  Gene Name: CD63 molecule
  Uniprot ID: P08962
  ENSP ID: ENSP00000393502

SEQ ID NO: 13236 - protein, 215 aa, Homo sapiens
  Payload ID: 2576
  Gene Symbol: CD63
  Gene Name: CD63 molecule
  ENSP ID: ENSP00000446752
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAF

SEQ ID NO: 13237 - protein, 215 aa, Homo sapiens
  Payload ID: 2576
  Gene Symbol: CD63
  Gene Name: CD63 molecule
  Uniprot ID: P08962
  ENSP ID: ENSP00000446807
MAVEGGMKCVKFLLYVLLLAFCGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 13238 - protein, 156 aa, Homo sapiens
  Payload ID: 2576
  Gene Symbol: CD63
  Gene Name: CD63 molecule
  Uniprot ID: P08962
  ENSP ID: ENSP00000447356
MITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 13239 - protein, 238 aa, Homo sapiens; identical to SEQ ID NO: 13234
  Payload ID: 2576
  Gene Symbol: CD63
  Gene Name: CD63 molecule
  Uniprot ID: P08962
  ENSP ID: ENSP00000447730

SEQ ID NO: 13240 - protein, 145 aa, Homo sapiens
  Payload ID: 2576
  Gene Symbol: CD63
  Gene Name: CD63 molecule
  ENSP ID: ENSP00000447938
MLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 13241 - protein, 156 aa, Homo sapiens; identical to SEQ ID NO: 13238
  Payload ID: 2576
  Gene Symbol: CD63
  Gene Name: CD63 molecule
  Uniprot ID: P08962
  ENSP ID: ENSP00000448091

SEQ ID NO: 13242 - protein, 217 aa, Homo sapiens
  Payload ID: 2576
  Gene Symbol: CD63
  Gene Name: CD63 molecule
  ENSP ID: ENSP00000449281
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVE

SEQ ID NO: 13243 - protein, 238 aa, Homo sapiens; identical to SEQ ID NO: 13234
  Payload ID: 2576
  Gene Symbol: CD63
  Gene Name: CD63 molecule
  Uniprot ID: P08962
  ENSP ID: ENSP00000449337

SEQ ID NO: 13244 - protein, 110 aa, Homo sapiens
  Payload ID: 2576
  Gene Symbol: CD63
  Gene Name: CD63 molecule
  ENSP ID: ENSP00000449435
MAVEGGMKCVKFLLYVLLLAFCACAVGLIAVGVGAQLVLSQTIIQGATPGSLLPVVIIAVGVFLFLVAFVGCCGACKENYCLMITLPSFCLLSCWWRWPQPLLAMCLEIR

SEQ ID NO: 13245 - protein, 145 aa, Homo sapiens; identical to SEQ ID NO: 13240
  Payload ID: 2576
  Gene Symbol: CD63
  Gene Name: CD63 molecule
  ENSP ID: ENSP00000449654

SEQ ID NO: 13246 - protein, 145 aa, Homo sapiens; identical to SEQ ID NO: 13240
  Payload ID: 2576
  Gene Symbol: CD63
  Gene Name: CD63 molecule
  ENSP ID: ENSP00000449684

SEQ ID NO: 13247 - protein, 133 aa, Homo sapiens
  Payload ID: 2576
  Gene Symbol: CD63
  Gene Name: CD63 molecule
  ENSP ID: ENSP00000450191
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTA

SEQ ID NO: 13248 - protein, 354 aa, Homo sapiens
  Payload ID: 2577
  Gene Symbol: CD68
  Gene Name: CD68 molecule
  Uniprot ID: P34810
  ENSP ID: ENSP00000250092
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 13249 - protein, 327 aa, Homo sapiens
  Payload ID: 2577
  Gene Symbol: CD68
  Gene Name: CD68 molecule
  Uniprot ID: P34810
  ENSP ID: ENSP00000369867
MRLAVLFSGALLGLLAESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 13250 - protein, 121 aa, Homo sapiens
  Payload ID: 2577
  Gene Symbol: CD68
  Gene Name: CD68 molecule
  ENSP ID: ENSP00000462198
  MOD_RES (1)..(1): Any amino acid
XKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSKTYLLLPS

SEQ ID NO: 13251 - protein, 180 aa, Homo sapiens
  Payload ID: 2577
  Gene Symbol: CD68
  Gene Name: CD68 molecule
  ENSP ID: ENSP00000462768
MRLAVLFSGALLGLLAATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGI

SEQ ID NO: 13252 - protein, 199 aa, Homo sapiens
  Payload ID: 2578
  Gene Symbol: CD69
  Gene Name: CD69 molecule
  Uniprot ID: Q07108
  ENSP ID: ENSP00000228434
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 13253 - protein, 164 aa, Homo sapiens
  Payload ID: 2578
  Gene Symbol: CD69
  Gene Name: CD69 molecule
  ENSP ID: ENSP00000442597
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNW

SEQ ID NO: 13254 - protein, 240 aa, Homo sapiens
  Payload ID: 2579
  Gene Symbol: CD7
  Gene Name: CD7 molecule
  Uniprot ID: P09564
  ENSP ID: ENSP00000312027
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 13255 - protein, 140 aa, Homo sapiens
  Payload ID: 2579
  Gene Symbol: CD7
  Gene Name: CD7 molecule
  ENSP ID: ENSP00000463489
MHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 13256 - protein, 221 aa, Homo sapiens
  Payload ID: 2579
  Gene Symbol: CD7
  Gene Name: CD7 molecule
  ENSP ID: ENSP00000463612
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQVSVSPSCHLHPKDCSLS

SEQ ID NO: 13257 - protein, 160 aa, Homo sapiens
  Payload ID: 2579
  Gene Symbol: CD7
  Gene Name: CD7 molecule
  ENSP ID: ENSP00000464182
MAGPPRLLLLPLLLALARGLPGALAAQGRTFSVLLARLMVTAQVLPRGAAVSPLHDCPRGSLRQHHLLHQRGPAWDLPEAARATAPRHHLLRGRGGAHYGQTVPGPHRLLRVPGQPDYHHAPPAAVGHWHLHLPGHHGGQCLRLRHPGPGDRGTVPRMAQ

SEQ ID NO: 13258 - protein, 35 aa, Homo sapiens
  Payload ID: 2579
  Gene Symbol: CD7
  Gene Name: CD7 molecule
  ENSP ID: ENSP00000464546
MAGPPRLLLLPLLLALARGLPGALAAQAGACVGST

SEQ ID NO: 13259 - protein, 121 aa, Homo sapiens
  Payload ID: 2579
  Gene Symbol: CD7
  Gene Name: CD7 molecule
  ENSP ID: ENSP00000464565
MHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQVSVSPSCHLHPKDCSLS

SEQ ID NO: 13260 - protein, 193 aa, Homo sapiens
  Payload ID: 2580
  Gene Symbol: CD70
  Gene Name: CD70 molecule
  Uniprot ID: P32970
  ENSP ID: ENSP00000245903
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 13261 - protein, 208 aa, Homo sapiens
  Payload ID: 2580
  Gene Symbol: CD70
  Gene Name: CD70 molecule
  Uniprot ID: P32970
  ENSP ID: ENSP00000395294
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGLFGFWNWGLKVKCFLRHLIWTAHCFIPLTQLVFMQALQSWRNHHCSHFTDEENRGVNR

SEQ ID NO: 13262 - protein, 65 aa, Homo sapiens
  Payload ID: 2580
  Gene Symbol: CD70
  Gene Name: CD70 molecule
  ENSP ID: ENSP00000470805
MPEEGSGCSVRRRPYGCVLRAALVPLVAGLVICLVVCIQRFAQAQQQLPLESLGWDVAELQLNHT

SEQ ID NO: 13263 - protein, 359 aa, Homo sapiens
  Payload ID: 2581
  Gene Symbol: CD72
  Gene Name: CD72 molecule
  Uniprot ID: P21854
  ENSP ID: ENSP00000259633
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 13264 - protein, 120 aa, Homo sapiens
  Payload ID: 2581
  Gene Symbol: CD72
  Gene Name: CD72 molecule
  ENSP ID: ENSP00000367687
MAEAITYADLRFVKAPLKKSISSRLGQDPGADDDGEITYENVQVPAVLGVPSSLASSVLGDKAAVKSEQPTASWRAVTSPAVGRILPCECACAGQPRGQVLAPVPAADGAGPRGVQLLPG

SEQ ID NO: 13265 - protein, 119 aa, Homo sapiens
  Payload ID: 2581
  Gene Symbol: CD72
  Gene Name: CD72 molecule
  ENSP ID: ENSP00000367688
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRCE

SEQ ID NO: 13266 - protein, 359 aa, Homo sapiens; identical to SEQ ID NO: 13263
  Payload ID: 2581
  Gene Symbol: CD72
  Gene Name: CD72 molecule
  Uniprot ID: P21854
  ENSP ID: ENSP00000379980

SEQ ID NO: 13267 - protein, 359 aa, Homo sapiens [sequence omitted]

SEQ ID NO: 13268 - protein, 296 aa, Homo sapiens
  Payload ID: 2582
  Gene Symbol: CD74
  Gene Name: CD74 molecule, major histocompatibility complex, class II invariant chain
  Uniprot ID: P04233
  ENSP ID: ENSP00000009530
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 13269 - protein, 232 aa, Homo sapiens
  Payload ID: 2582
  Gene Symbol: CD74
  Gene Name: CD74 molecule, major histocompatibility complex, class II invariant chain
  Uniprot ID: P04233
  ENSP ID: ENSP00000230685
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 13270 - protein, 160 aa, Homo sapiens
  Payload ID: 2582
  Gene Symbol: CD74
  Gene Name: CD74 molecule, major histocompatibility complex, class II invariant chain
  Uniprot ID: P04233
  ENSP ID: ENSP00000367026
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQSHWNWRTRLLGWV

SEQ ID NO: 13271 - protein, 152 aa, Homo sapiens [sequence omitted]

SEQ ID NO: 13272 - protein, 52 aa, Homo sapiens
  Payload ID: 2582
  Gene Symbol: CD74
  Gene Name: CD74 molecule, major histocompatibility complex, class II invariant chain
  ENSP ID: ENSP00000429478
MHRRRSRSCREDQKPVMDDQRDLISNNEQLPMLGRRPGAPESPCRMPPSMAT

SEQ ID NO: 13273 - protein, 122 aa, Homo sapiens
  Payload ID: 2582
  Gene Symbol: CD74
  Gene Name: CD74 molecule, major histocompatibility complex, class II invariant chain
  ENSP ID: ENSP00000429641
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPHAECHQVWQHDRGPCDAPAPEC

SEQ ID NO: 13274 - protein, 316 aa, Homo sapiens
  Payload ID: 2582
  Gene Symbol: CD74
  Gene Name: CD74 molecule, major histocompatibility complex, class II invariant chain
  ENSP ID: ENSP00000430614
  MOD_RES (1)..(1): Any amino acid
XRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPGKGLAEGHLVTSSSSPAGPAPLWAGEGV

SEQ ID NO: 13275 - protein, 145 aa, Homo sapiens
  Payload ID: 2582
  Gene Symbol: CD74
  Gene Name: CD74 molecule, major histocompatibility complex, class II invariant chain
  ENSP ID: ENSP00000430654
  MOD_RES (1)..(1): Any amino acid
XRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQY

SEQ ID NO: 13276 - protein, 226 aa, Homo sapiens
  Payload ID: 2583
  Gene Symbol: CD79A
  Gene Name: CD79a molecule, immunoglobulin-associated alpha
  Uniprot ID: P11912
  ENSP ID: ENSP00000221972
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 13277 - protein, 188 aa, Homo sapiens
  Payload ID: 2583
  Gene Symbol: CD79A
  Gene Name: CD79a molecule, immunoglobulin-associated alpha
  Uniprot ID: P11912
  ENSP ID: ENSP00000400605
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 13278 - protein, 258 aa, Homo sapiens
  Payload ID: 2583
  Gene Symbol: CD79A
  Gene Name: CD79a molecule, immunoglobulin-associated alpha
  ENSP ID: ENSP00000468922
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRREWPSPGPYSHCPAGDTRFIFEVGIEPVPSMWVSNRLGQRDGHSPLQSGVSGGSGALQEVGGARRLGRARGARALSHTTSLQSRPPGPSWTWGRAPRTESSQPRGSSSCSARWCLGRCCCSGNDGRTRSSGW

SEQ ID NO: 13279 - protein, 229 aa, Homo sapiens
  Payload ID: 2584
  Gene Symbol: CD79B
  Gene Name: CD79b molecule, immunoglobulin-associated beta
  Uniprot ID: P40259
  ENSP ID: ENSP00000006750
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 13280 - protein, 125 aa, Homo sapiens
  Payload ID: 2584
  Gene Symbol: CD79B
  Gene Name: CD79b molecule, immunoglobulin-associated beta
  Uniprot ID: P40259
  ENSP ID: ENSP00000245862
MARLALSPVPSHWMVALLLLLSAEPVPAARSEDRYRNPKGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 13281 - protein, 230 aa, Homo sapiens
  Payload ID: 2584
  Gene Symbol: CD79B
  Gene Name: CD79b molecule, immunoglobulin-associated beta
  Uniprot ID: P40259
  ENSP ID: ENSP00000376544
MARLALSPVPSHWMVALLLLLSAAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 13282 - protein, 288 aa, Homo sapiens
  Payload ID: 2585
  Gene Symbol: CD80
  Gene Name: CD80 molecule
  Uniprot ID: P33681
  ENSP ID: ENSP00000264246
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 13283 - protein, 256 aa, Homo sapiens
  Payload ID: 2585
  Gene Symbol: CD80
  Gene Name: CD80 molecule
  Uniprot ID: P33681
  ENSP ID: ENSP00000373165
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTSFAPRCRERRRNERLRRESVRPV

SEQ ID NO: 13284 - protein, 288 aa, Homo sapiens; identical to SEQ ID NO: 13282
  Payload ID: 2585
  Gene Symbol: CD80
  Gene Name: CD80 molecule
  Uniprot ID: P33681
  ENSP ID: ENSP00000418364

SEQ ID NO: 13285 - protein, 236 aa, Homo sapiens
  Payload ID: 2586
  Gene Symbol: CD81
  Gene Name: CD81 molecule
  Uniprot ID: P60033
  ENSP ID: ENSP00000263645
MGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 13286 - protein, 274 aa, Homo sapiens
  Payload ID: 2586
  Gene Symbol: CD81
  Gene Name: CD81 molecule
  ENSP ID: ENSP00000370424
MWCGWSFSWQPVHWVRSACGCSLTWVSWSLASSSSRSLLKVGELGMAPFVHARAGKTKAQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 13287 - protein, 165 aa, Homo sapiens
  Payload ID: 2586
  Gene Symbol: CD81
  Gene Name: CD81 molecule
  ENSP ID: ENSP00000431780
MMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 13288 - protein, 242 aa, Homo sapiens
  Payload ID: 2586
  Gene Symbol: CD81
  Gene Name: CD81 molecule
  ENSP ID: ENSP00000432033
MEEVTEAQKTHQARLGCEVPCCSSLAVSNPTSSQLGGPWWVRHPGPSGVLGCGECVGTHLVSLSPQGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 13289 - protein, 209 aa, Homo sapiens
  Payload ID: 2586
  Gene Symbol: CD81
  Gene Name: CD81 molecule
  ENSP ID: ENSP00000432249
MAPFVHARAGKTKAQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIM

SEQ ID NO: 13290 - protein, 99 aa, Homo sapiens
  Payload ID: 2586
  Gene Symbol: CD81
  Gene Name: CD81 molecule
  ENSP ID: ENSP00000432497
MCKPATDPRFTRSPLAGGVILGVALWLRHDPQTTNLLYLELGDKPAPNTFYVGIYILIAVGAVMMFVGFLGCYGAIQESQCLLGTFFTCLVILFACEVA

SEQ ID NO: 13291 - protein, 51 aa, Homo sapiens
  Payload ID: 2586
  Gene Symbol: CD81
  Gene Name: CD81 molecule
  ENSP ID: ENSP00000432723
MMFVGFLGCYGAIQESQCLLGTFFTCLVILFACEVAAGIWGFVNKDQIAKD

SEQ ID NO: 13292 - protein, 92 aa, Homo sapiens
  Payload ID: 2586
  Gene Symbol: CD81
  Gene Name: CD81 molecule
  ENSP ID: ENSP00000433178
MMFVGFLGCYGAIQESQCLLGTFFTCLVILFACEVAAGIWGFVNKDQIAKDVKQFYDQALQQAVVDDDANNAKAVVKTFHETLDCCGSSTLT

SEQ ID NO: 13293 - protein, 225 aa, Homo sapiens
  Payload ID: 2586
  Gene Symbol: CD81
  Gene Name: CD81 molecule
  ENSP ID: ENSP00000433767
GGSRWQRGFPQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 13294 - protein, 221 aa, Homo sapiens
  Payload ID: 2586
  Gene Symbol: CD81
  Gene Name: CD81 molecule
  ENSP ID: ENSP00000433904
  MOD_RES (1)..(1): Any amino acid
XQRGFPQLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMVSGRGRRACSLGCPFRGALC

SEQ ID NO: 13295 - protein, 148 aa, Homo sapiens
  Payload ID: 2586
  Gene Symbol: CD81
  Gene Name: CD81 molecule
  ENSP ID: ENSP00000435633
QTQDVPLPAPEAPSPDELAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHET

SEQ ID NO: 13296 - protein, 165 aa, Homo sapiens; identical to SEQ ID NO: 13287
  Payload ID: 2586
  Gene Symbol: CD81
  Gene Name: CD81 molecule
  ENSP ID: ENSP00000437242

SEQ ID NO: 13297 - protein, 267 aa, Homo sapiens
  Payload ID: 2587
  Gene Symbol: CD82
  Gene Name: CD82 molecule
  Uniprot ID: P27701
  ENSP ID: ENSP00000227155
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 13298 - protein, 242 aa, Homo sapiens
  Payload ID: 2587
  Gene Symbol: CD82
  Gene Name: CD82 molecule
  Uniprot ID: P27701
  ENSP ID: ENSP00000339686
MGSACIKVTKYFLFLFNLIFFILGAVILGFGVWILADKSSFISVLQTSSSSLRMGAYVFIGVGAVTMLMGFLGCIGAVNEVRCLLGLLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 13299 - protein, 108 aa, Homo sapiens
  Payload ID: 2587
  Gene Symbol: CD82
  Gene Name: CD82 molecule
  ENSP ID: ENSP00000431767
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYF

SEQ ID NO: 13300 - protein, 57 aa, Homo sapiens
  Payload ID: 2587
  Gene Symbol: CD82
  Gene Name: CD82 molecule
  ENSP ID: ENSP00000433036
DNSLSVRKGFCEAPGNRTQSGNHPEDWPVYQELLGMVLSICLCRHVHSEDYSKVPKY

SEQ ID NO: 13301 - protein, 179 aa, Homo sapiens
  Payload ID: 2587
  Gene Symbol: CD82
  Gene Name: CD82 molecule
  ENSP ID: ENSP00000433151
MARDWIRPQRASDCWSGKQQLFQIIIIIIISPPCCCVDDTWAQAEVGPVTSCTGFVEGSSRTGGMGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKVSP

SEQ ID NO: 13302 - protein, 157 aa, Homo sapiens
  Payload ID: 2587
  Gene Symbol: CD82
  Gene Name: CD82 molecule
  ENSP ID: ENSP00000433788
MEILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSC

SEQ ID NO: 13303 - protein, 104 aa, Homo sapiens
  Payload ID: 2587
  Gene Symbol: CD82
  Gene Name: CD82 molecule
  ENSP ID: ENSP00000433804
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGA

SEQ ID NO: 13304 - protein, 38 aa, Homo sapiens
  Payload ID: 2587
  Gene Symbol: CD82
  Gene Name: CD82 molecule
  ENSP ID: ENSP00000435661
MGSACIKVTKYFLFLFNLIFFILGAVILGFGVWILADK

SEQ ID NO: 13305 - protein, 161 aa, Homo sapiens
  Payload ID: 2587
  Gene Symbol: CD82
  Gene Name: CD82 molecule
  ENSP ID: ENSP00000435682
MPLVINQSPPCCCVDDTWAQAEVGPVTSCTGFVEGSSRTGGMGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGI

SEQ ID NO: 13306 - protein, 68 aa, Homo sapiens
  Payload ID: 2587
  Gene Symbol: CD82
  Gene Name: CD82 molecule
  ENSP ID: ENSP00000436403
MGSACIKVTKYFLFLFNLIFFILGAVILGFGVWILADKSSFISVLQTSSSSLRMGAYVFIGVGAVTML

SEQ ID NO: 13307 - protein, 205 aa, Homo sapiens
  Payload ID: 2588
  Gene Symbol: CD83
  Gene Name: CD83 molecule
  Uniprot ID: Q01151
  ENSP ID: ENSP00000368450
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 13308 - protein, 146 aa, Homo sapiens
  Payload ID: 2588
  Gene Symbol: CD83
  Gene Name: CD83 molecule
  ENSP ID: ENSP00000480760
METPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 13309 - protein, 345 aa, Homo sapiens
  Payload ID: 2589
  Gene Symbol: CD84
  Gene Name: CD84 molecule
  Uniprot ID: Q9UIB8
  ENSP ID: ENSP00000312367
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 13310 - protein, 339 aa, Homo sapiens
  Payload ID: 2589
  Gene Symbol: CD84
  Gene Name: CD84 molecule
  Uniprot ID: Q9UIB8
  ENSP ID: ENSP00000357027
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 13311 - protein, 272 aa, Homo sapiens
  Payload ID: 2589
  Gene Symbol: CD84
  Gene Name: CD84 molecule
  Uniprot ID: Q9UIB8
  ENSP ID: ENSP00000357030
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGASLQGRASEHSLFRSAVC

SEQ ID NO: 13312 - protein, 328 aa, Homo sapiens
  Payload ID: 2589
  Gene Symbol: CD84
  Gene Name: CD84 molecule
  Uniprot ID: Q9UIB8
  ENSP ID: ENSP00000357033
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 13313 - protein, 214 aa, Homo sapiens
  Payload ID: 2589
  Gene Symbol: CD84
  Gene Name: CD84 molecule
  Uniprot ID: Q9UIB8
  ENSP ID: ENSP00000442845
MAQHHLWILLLCLQTCRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 13314 - protein, 275 aa, Homo sapiens
  Payload ID: 2590
  Gene Symbol: CD86
  Gene Name: CD86 molecule
  Uniprot ID: P42081
  ENSP ID: ENSP00000264468
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIGTNTMEREESEQTKKREKIHIPERSDEAQRVFKSSKTSSCDKSDTCF

SEQ ID NO: 13315 - protein, 329 aa, Homo sapiens
  Payload ID: 2590
  Gene Symbol: CD86
  Gene Name: CD86 molecule
  Uniprot ID: P42081
  ENSP ID: ENSP00000332049
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 13316 - protein, 323 aa, Homo sapiens
  Payload ID: 2590
  Gene Symbol: CD86
  Gene Name: CD86 molecule
  Uniprot ID: P42081
  ENSP ID: ENSP00000377248
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 13317 - protein, 277 aa, Homo sapiens
  Payload ID: 2590
  Gene Symbol: CD86
  Gene Name: CD86 molecule
  ENSP ID: ENSP00000417195
  MOD_RES (1)..(1): Any amino acid
XTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIGTNTMEREESEQTKKREKIHIPERSDEAQRVFKSSKTSSCDKSDTCF

SEQ ID NO: 13318 - protein, 247 aa, Homo sapiens
  Payload ID: 2590
  Gene Symbol: CD86
  Gene Name: CD86 molecule
  Uniprot ID: P42081
  ENSP ID: ENSP00000418988
MGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 13319 - protein, 167 aa, Homo sapiens
  Payload ID: 2590
  Gene Symbol: CD86
  Gene Name: CD86 molecule
  ENSP ID: ENSP00000419116
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLL

SEQ ID NO: 13320 - protein, 217 aa, Homo sapiens
  Payload ID: 2590
  Gene Symbol: CD86
  Gene Name: CD86 molecule
  Uniprot ID: P42081
  ENSP ID: ENSP00000420230
MDPQCTMGLSNILFVMAFLLSANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 13321 - protein, 235 aa, Homo sapiens
  Payload ID: 2591
  Gene Symbol: CD8A
  Gene Name: CD8a molecule
  Uniprot ID: P01732
  ENSP ID: ENSP00000283635
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 13322 - protein, 198 aa, Homo sapiens
  Payload ID: 2591
  Gene Symbol: CD8A
  Gene Name: CD8a molecule
  Uniprot ID: P01732
  ENSP ID: ENSP00000321631
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAGNRRRVCKCPRPVVKSGDKPSLSARYV

SEQ ID NO: 13323 - protein, 235 aa, Homo sapiens; identical to SEQ ID NO: 13321
  Payload ID: 2591
  Gene Symbol: CD8A
  Gene Name: CD8a molecule
  Uniprot ID: P01732
  ENSP ID: ENSP00000386559

SEQ ID NO: 13324 - protein, 198 aa, Homo sapiens
  Payload ID: 2591
  Gene Symbol: CD8A
  Gene Name: CD8a molecule
  ENSP ID: ENSP00000387314
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPVHTRGLDFACDIYIWAPLAGTCGVLLLSLVITLYCNHRNRRRVCKCPRPVVKSGDKPSLSARYV

SEQ ID NO: 13325 - protein, 243 aa, Homo sapiens
  Payload ID: 2592
  Gene Symbol: CD8B
  Gene Name: CD8b molecule
  Uniprot ID: P10966
  ENSP ID: ENSP00000331172
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQPQGEGISGTFVPQCLHGYYSNTTTSQKLLNPWILKT

SEQ ID NO: 13326 - protein, 213 aa, Homo sapiens
  Payload ID: 2592
  Gene Symbol: CD8B
  Gene Name: CD8b molecule
  Uniprot ID: P10966
  ENSP ID: ENSP00000340592
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGRRRRARLRFMKQPQGEGISGTFVPQCLHGYYSNTTTSQKLLNPWILKT

SEQ ID NO: 13327 - protein, 210 aa, Homo sapiens
  Payload ID: 2592
  Gene Symbol: CD8B
  Gene Name: CD8b molecule
  Uniprot ID: P10966
  ENSP ID: ENSP00000375070
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 13328 - protein, 221 aa, Homo sapiens
  Payload ID: 2592
  Gene Symbol: CD8B
  Gene Name: CD8b molecule
  Uniprot ID: P10966
  ENSP ID: ENSP00000377356
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLRLHPLEKCSRMDY

SEQ ID NO: 13329 - protein, 198 aa, Homo sapiens
  Payload ID: 2592
  Gene Symbol: CD8B
  Gene Name: CD8b molecule
  Uniprot ID: P10966
  ENSP ID: ENSP00000377358
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGLKGKVYQEPLSPNACMDTTAILQPHRSCLTHGS

SEQ ID NO: 13330 - protein, 210 aa, Homo sapiens
  Payload ID: 2592
  Gene Symbol: CD8B
  Gene Name: CD8b molecule
  ENSP ID: ENSP00000394806
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLYK

SEQ ID NO: 13331 - protein, 228 aa, Homo sapiens
  Payload ID: 2593
  Gene Symbol: CD9
  Gene Name: CD9 molecule
  Uniprot ID: P21926
  ENSP ID: ENSP00000009180
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 13332 - protein, 159 aa, Homo sapiens
  Payload ID: 2593
  Gene Symbol: CD9
  Gene Name: CD9 molecule
  ENSP ID: ENSP00000371955
MMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 13333 - protein, 228 aa, Homo sapiens; identical to SEQ ID NO: 13331
  Payload ID: 2593
  Gene Symbol: CD9
  Gene Name: CD9 molecule
  Uniprot ID: P21926
  ENSP ID: ENSP00000371958

SEQ ID NO: 13334 - protein, 228 aa, Homo sapiens
  Payload ID: 2593
  Gene Symbol: CD9
  Gene Name: CD9 molecule
  ENSP ID: ENSP00000371959
MPVKGGTKCIKYLLFGFNFIFWLAGIAVLAIGLWLRFDSQTKSIFEQETNNNNSSFYTGVYILIGAGALMMLVGFLGCCGAVQESQCMLGLATKRTMFPPFLEDHVCFFSLNPQFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAV

SEQ ID NO: 13335 - protein, 141 aa, Homo sapiens
  Payload ID: 2593
  Gene Symbol: CD9
  Gene Name: CD9 molecule
  ENSP ID: ENSP00000440985
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRE

SEQ ID NO: 13336 - protein, 182 aa, Homo sapiens
  Payload ID: 2593
  Gene Symbol: CD9
  Gene Name: CD9 molecule
  ENSP ID: ENSP00000478288
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYAVELLWFGWGRGTVYLRHLPQEGRTRNLHREVLS

SEQ ID NO: 13337 - protein, 181 aa, Homo sapiens
  Payload ID: 2593
  Gene Symbol: CD9
  Gene Name: CD9 molecule
  ENSP ID: ENSP00000482643
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNLWFGWGRGTVYLRHLPQEGRTRNLHREVLS

SEQ ID NO: 13338 - protein, 652 aa, Homo sapiens
  Payload ID: 2594
  Gene Symbol: CD93
  Gene Name: CD93 molecule
  Uniprot ID: Q9NPY3
  ENSP ID: ENSP00000246006
MATSMGLLLLLLLLLTQPGAGTGADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPSRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATCVLGPHGKNYTCRCPQGYQLDSSQLDCVDVDECQDSPCAQECVNTPGGFRCECWVGYEPGGPGEGACQDVDECALGRSPCAQGCTNTDGSFHCSCEEGYVLAGEDGTQCQDVDECVGPGGPLCDSLCFNTQGSFHCGCLPGWVLAPNGVSCTMGPVSLGPPSGPPDEEDKGEKEGSTVPRAATASPTRGPEGTPKATPTTSRPSLSSDAPITSAPLKMLAPSGSPGVWREPSIHHATAASGPQEPAGGDSSVATQNNDGTDGQKLLLFYILGTVVAILLLLALALGLLVYRKRRAKREEKKEKKPQNAADSYSWVPERAESRAMENQYSPTPGTDC

SEQ ID NO: 13339 - protein, 585 aa, Homo sapiens
  Payload ID: 2595
  Gene Symbol: CD96
  Gene Name: CD96 molecule
  Uniprot ID: P40200
  ENSP ID: ENSP00000283285
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVENSSTDSWVLLSKGIKEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 13340 - protein, 569 aa, Homo sapiens
  Payload ID: 2595
  Gene Symbol: CD96
  Gene Name: CD96 molecule
  Uniprot ID: P40200
  ENSP ID: ENSP00000342040
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 13341 - protein, 402 aa, Homo sapiens
  Payload ID: 2595
  Gene Symbol: CD96
  Gene Name: CD96 molecule
  ENSP ID: ENSP00000389801
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPASKNVFTLSY

SEQ ID NO: 13342 - protein, 146 aa, Homo sapiens
  Payload ID: 2595
  Gene Symbol: CD96
  Gene Name: CD96 molecule
  ENSP ID: ENSP00000417150
  MOD_RES (1)..(1): Any amino acid
XEIPCFQNSSSKISSEFTYAWSVEDNGTQETLISQNHLISNSTLLKDRVKLGTDYRLHLSPVQIFDDGRKFSCHIRVGPNKILRSSTTVKVFGKGFCSTDSLASSCLLPCSSLKRKHPIMLQSSHMWVTVLESVSLDTCHSCWAGG

SEQ ID NO: 13343 - protein, 568 aa, Homo sapiens
  Payload ID: 2595
  Gene Symbol: CD96
  Gene Name: CD96 molecule
  ENSP ID: ENSP00000417152
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKFSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 13344 - protein, 118 aa, Homo sapiens
  Payload ID: 2595
  Gene Symbol: CD96
  Gene Name: CD96 molecule
  ENSP ID: ENSP00000417680
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGSYSR

SEQ ID NO: 13345 - protein, 18 aa, Homo sapiens
  Payload ID: 2595
  Gene Symbol: CD96
  Gene Name: CD96 molecule
  ENSP ID: ENSP00000475194
MEKKWKYCAVYYIIQIHF

SEQ ID NO: 13346 - protein, 61 aa, Homo sapiens
  Payload ID: 2596
  Gene Symbol: CD99
  Gene Name: CD99 molecule
  ENSP ID: ENSP00000370570
TRKRSYASKKMKELPCACSSVFREKKATLKIEENEAAWITLLKFISACAMHEKILAKSSLT

SEQ ID NO: 13347 - protein, 76 aa, Homo sapiens
  Payload ID: 2596
  Gene Symbol: CD99
  Gene Name: CD99 molecule
  ENSP ID: ENSP00000370573
MARGAALALLLFGLLGVLVAAPGFGDLRLQAARGGRPGVACHSHALRPGPKFGIARSLRPGWWGEGKEKLEKNFEP

SEQ ID NO: 13348 - protein, 177 aa, Homo sapiens
  Payload ID: 2596
  Gene Symbol: CD99
  Gene Name: CD99 molecule
  ENSP ID: ENSP00000370579
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENGQLAGSLGPCIGIRREADG

SEQ ID NO: 13349 - protein, 169 aa, Homo sapiens
  Payload ID: 2596
  Gene Symbol: CD99
  Gene Name: CD99 molecule
  Uniprot ID: P14209
  ENSP ID: ENSP00000370582
MARGAALALLLFGLLGVLVAAPDGGFDLSDALPGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 13350 - protein, 185 aa, Homo sapiens
  Payload ID: 2596
  Gene Symbol: CD99
  Gene Name: CD99 molecule
  Uniprot ID: P14209
  ENSP ID: ENSP00000370588
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 13351 - protein, 201 aa, Homo sapiens
  Payload ID: 2596
  Gene Symbol: CD99
  Gene Name: CD99 molecule
  ENSP ID: ENSP00000405544
RRWGRPAGTPGASSLPGRTRCAHGGPGPEEAPTFSPTLFLEPFQREKSAFVVGVANSYMWGGLGRDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKEN

SEQ ID NO: 13352 - protein, 160 aa, Homo sapiens
  Payload ID: 2596
  Gene Symbol: CD99
  Gene Name: CD99 molecule
  Uniprot ID: P14209
  ENSP ID: ENSP00000479999
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENDG

SEQ ID NO: 13353 - protein, 184 aa, Homo sapiens
  Payload ID: 2596
  Gene Symbol: CD99
  Gene Name: CD99 molecule
  ENSP ID: ENSP00000485427
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENEQGEVDMESHRNANAEPAVQRTLLEK

SEQ ID NO: 13354 - protein, 160 aa, Homo sapiens; identical to SEQ ID NO: 13352
  Payload ID: 2596
  Gene Symbol: CD99
  Gene Name: CD99 molecule
  Uniprot ID: P14209
  ENSP ID: ENSP00000485545

SEQ ID NO: 13355 - protein, 190 aa, Homo sapiens
  Payload ID: 2597
  Gene Symbol: CD99L2
  Gene Name: CD99 molecule-like 2
  Uniprot ID: Q8TCZ2
  ENSP ID: ENSP00000347275
MVAWRSAFLVCLAFSLATLVQRGSGDFDDFNLEDAVKETSSVKRNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 13356 - protein, 262 aa, Homo sapiens
  Payload ID: 2597
  Gene Symbol: CD99L2
  Gene Name: CD99 molecule-like 2
  Uniprot ID: Q8TCZ2
  ENSP ID: ENSP00000359403
MVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 13357 - protein, 157 aa, Homo sapiens
  Payload ID: 2597
  Gene Symbol: CD99L2
  Gene Name: CD99 molecule-like 2
  ENSP ID: ENSP00000391821
  MOD_RES (1)..(1): Any amino acid
XTSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGGFLNPEAPVGHVKGK

SEQ ID NO: 13358 - protein, 189 aa, Homo sapiens
  Payload ID: 2597
  Gene Symbol: CD99L2
  Gene Name: CD99 molecule-like 2
  Uniprot ID: Q8TCZ2
  ENSP ID: ENSP00000394858
MVAWRSAFLVCLAFSLATLVQRGSGDFDDFNLEDAVKETSSVKQPWDHTTTTTTNRPGTTRAPAKPPGSGLDLADALDDQDDGRRKPGIGGRGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 13359 - protein, 213 aa, Homo sapiens
  Payload ID: 2597
  Gene Symbol: CD99L2
  Gene Name: CD99 molecule-like 2
  Uniprot ID: Q8TCZ2
  ENSP ID: ENSP00000417697
MVAWRSAFLVCLAFSLATLVQRGSGDFDDFNLEDAVKETSSVKQRWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 13360 - protein, 272 aa, Homo sapiens
  Payload ID: 2597
  Gene Symbol: CD99L2
  Gene Name: CD99 molecule-like 2
  Uniprot ID: Q8TCZ2
  ENSP ID: ENSP00000480322
MVAWRSAFLVCLAFSLATLVQRGSGDFDDFNLEDAVKETSSVKQPWDHTTTTTTNRPGTTRAPAKPPGPTEGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQHAAAGQEGLNADYVKGENLEAVVCEEPQVKYSTLHTQSAEPPPPPEPARI

SEQ ID NO: 13361 - protein, 177 aa, Homo sapiens
  Payload ID: 2597
  Gene Symbol: CD99L2
  Gene Name: CD99 molecule-like 2
  ENSP ID: ENSP00000489166
  MOD_RES (1)..(1): Any amino acid
XERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQHAAAGQEGLNADYVKGENLEAVVCEEPQVKYSTLHTQSAEPPPPPEPARI

SEQ ID NO: 13362 - protein, 145 aa, Homo sapiens
  Payload ID: 2597
  Gene Symbol: CD99L2
  Gene Name: CD99 molecule-like 2
  ENSP ID: ENSP00000489222
MVAWRSAFLVCLAFSLATLVQRGSGDFDDFNLEDAVKETSSVKPALGMYHKLDGLKQQNFILSLFWMLEVLYQGVGWATFSLKALGKNLSLTFPTSGGSRCSLVCGCITPISASVVTWCSPFCVSLLSLTKMLVSGFKAHLDNPG

SEQ ID NO: 13363 - protein, 79 aa, Homo sapiens [sequence omitted]

SEQ ID NO: 13364 - protein, 67 aa, Homo sapiens
  Payload ID: 2598
  Gene Symbol: CKS1B
  Gene Name: CDC28 protein kinase regulatory subunit 1B
  ENSP ID: ENSP00000357421
MSHKQIYYSDKYDDEEFEYRHVMLPKDIAKLVPKTHLMSESEWRNLGVQQSQGWVHYMIHEPGQCTG

SEQ ID NO: 13365 - protein, 63 aa, Homo sapiens
  Payload ID: 2598
  Gene Symbol: CKS1B
  Gene Name: CDC28 protein kinase regulatory subunit 1B
  ENSP ID: ENSP00000357424
MRTRHVMLPKDIAKLVPKTHLMSESEWRNLGVQQSQGWVHYMIHEPEPHILLFRRPLPKKPKK

SEQ ID NO: 13366 - protein, 79 aa, Homo sapiens
  Payload ID: 2599
  Gene Symbol: CKS2
  Gene Name: CDC28 protein kinase regulatory subunit 2
  Uniprot ID: P33552
  ENSP ID: ENSP00000364976
MAHKQIYYSDKYFDEHYEYRHVMLPRELSKQVPKTHLMSEEEWRRLGVQQSLGWVHYMIHEPEPHILLFRRPLPKDQQK

SEQ ID NO: 13367 - protein, 1732 aa, Homo sapiens
  Payload ID: 2600
  Gene Symbol: CDC42BPA
  Gene Name: CDC42 binding protein kinase alpha (DMPK-like)
  Uniprot ID: Q5VT25
  ENSP ID: ENSP00000335341
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFERSPSCTPASKGRRTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13368 - protein, 1699 aa, Homo sapiens
  Payload ID: 2600
  Gene Symbol: CDC42BPA
  Gene Name: CDC42 binding protein kinase alpha (DMPK-like)
  ENSP ID: ENSP00000355726
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKASKGRRTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13369 - protein, 1018 aa, Homo sapiens
  Payload ID: 2600
  Gene Symbol: CDC42BPA
  Gene Name: CDC42 binding protein kinase alpha (DMPK-like)
  ENSP ID: ENSP00000355728
MILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13370 - protein, 1638 aa, Homo sapiens
  Payload ID: 2600
  Gene Symbol: CDC42BPA
  Gene Name: CDC42 binding protein kinase alpha (DMPK-like)
  Uniprot ID: Q5VT25
  ENSP ID: ENSP00000355729
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKLEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13371 - protein, 1719 aa, Homo sapiens
  Payload ID: 2600
  Gene Symbol: CDC42BPA
  Gene Name: CDC42 binding protein kinase alpha (DMPK-like)
  Uniprot ID: Q5VT25
  ENSP ID: ENSP00000355731
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDNKWITTLHYAFQDDNNLYLVMDYYVGGDLLTLLSKFEDRLPEDMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPAQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELSRKLQESTQTVQALQYSTVDGPLTASKDLEIKNLKEEIEKLRKQVTESSHLEQQLEEANAVRQELDDAFRQIKAYEKQIKTLQQEREDLNKELVQASERLKNQSKELKDAHCQRKLAMQEFMEINERLTELHTQKQKLARHVRDKEEEVDLVMQKVESLRQELRRTERAKKELEVHTEALAAEASKDRKLREQSEHYSKQLENELEGLKQKQISYSPGVCSIEHQQEITKLKTDLEKKSIFYEEELSKREGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13372 - protein, 1048 aa, Homo sapiens
  Payload ID: 2600
  Gene Symbol: CDC42BPA
  Gene Name: CDC42 binding protein kinase alpha (DMPK-like)
  ENSP ID: ENSP00000401051
  MOD_RES (1)..(1): Any amino acid
XEGIHANEIKNLKKELHDSEGQQLALNKEIMILKDKLEKTRRESQSEREEFESEFKQQYEREKVLLTEENKKLTSELDKLTTLYENLSIHNQQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13373 - protein, 546 aa, Homo sapiens
  Payload ID: 2600
  Gene Symbol: CDC42BPA
  Gene Name: CDC42 binding protein kinase alpha (DMPK-like)
  ENSP ID: ENSP00000407120
  MOD_RES (1)..(1): Any amino acid
XDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSASKCRGYRKVPLRQGDPQLPPLLSRG

SEQ ID NO: 13374 - protein, 728 aa, Homo sapiens
  Payload ID: 2600
  Gene Symbol: CDC42BPA
  Gene Name: CDC42 binding protein kinase alpha (DMPK-like)
  ENSP ID: ENSP00000408165
  MOD_RES (1)..(1): Any amino acid
XVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFEDSFSSSSSSLIDFLDDTDPVENTYVWNPSVKFHIQSRSTSPSTSSEAEPVKTVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMA

SEQ ID NO: 13375 - protein, 984 aa, Homo sapiens
  Payload ID: 2600
  Gene Symbol: CDC42BPA
  Gene Name: CDC42 binding protein kinase alpha (DMPK-like)
  ENSP ID: ENSP00000415388
  MOD_RES (1)..(1): Any amino acid
XQLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGIEHQDSQHSFLAFLNTPTDALDQFETVDSTPLSVHTPTLRKKGCPGSTGFPPKRKTHQFFVKSFTTPTKCHQCTSLMVGLIRQGCSCEVCGFSCHITCVNKAPTTCPVPPEQTKGPLGIDPQKGIGTAYEGHVRIPKPAGVKKGWQRALAIVCDFKLFLYDIAEGKASQPSVVISQVIDMRDEEFSVSSVLASDVIHASRKDIPCIFRVTASQLSASNNKCSILMLADTENEKNKWVGVLSELHKILKKNKFRDRSVYVPKEAYDSTLPLIKTTQAAAIIDHERIALGNEEGLFVVHVTKDEIIRVGDNKKIHQIELIPNDQLVAVISGRNRHVRLFPMSALDGRETDFYKLSETKGCQTVTSGKVRHGALTCLCVAMKRQVLCYELFQSKTRHRKFKEIQVPYNVQWMAIFSEQLCVGFQSGFLRYPLNGEGNPYSMLHSNDHTLSFIAHQPMDAICAVEISSKEYLLCFNSIGIYTDCQGRRSRQQELMWPANPSSCCYNAPYLSVYSENAVDIFDVNSMEWIQTLPLKKVRPLNNEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMPGFPYPSPHHHSGLISSPINFEHIYHMTVNSAEKFLSPDSINPEYSPSLRSVPGTPSFMTLRNPRPQESRTVFSGSVSIPSITKSRPEPGRSMSASSGLSARSSAQNGSALKREFSGGSYSAKRQPMPSPSEGSLSSGGMDQGSDAPARDFDGEDSDSPRHSTASNSSNLSSPPSPASPRKTKSLSLESTDRGSWDP

SEQ ID NO: 13376 - protein, 1711 aa, Homo sapiens
  Payload ID: 2601
  Gene Symbol: CDC42BPB
  Gene Name: CDC42 binding protein kinase beta (DMPK-like)
  Uniprot ID: Q9Y5S2
  ENSP ID: ENSP00000355237
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEDMARPPQRPSAVPLPTTQALALAGPKPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAFLSQQSFDALCAVELESEEYLLCFSHMGLYVDPQGRRARAQELMWPAAPVACSCSPTHVTVYSEYGVDVFDVRTMEWVQTIGLRRIRPLNSEGTLNLLNCEPPRLIYFKSKFSGAVLNVPDTSDNSKKQMLRTRSKRRFVFKVPEEERLQQRREMLRDPELRSKMISNPTNFNHVAHMGPGDGMQVLMDLPLSAVPPSQEERPGPAPTNLARQPPSRNKPYISWPSSGGSEPSVTVPLRSMSDPDQDFDKEPDSDSTKHSTPSNSSNPSGPPSPNSPHRSQLPLEGLEQPACDT

SEQ ID NO: 13377 - protein, 666 aa, Homo sapiens
  Payload ID: 2601
  Gene Symbol: CDC42BPB
  Gene Name: CDC42 binding protein kinase beta (DMPK-like)
  ENSP ID: ENSP00000453384
  MOD_RES (1)..(1): Any amino acid
XALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGLKLPDFQDSIFEYFNTAPLAHDLTFRTSSASEQETQAPKPEASPSMSVAASEQQEPKAHQFSIKSFSSPTQCSHCTSLMVGLIRQGYACEVCSFACHVSCKDGAPQVCPIPPEQSKRPLGVDVQRGIGTAYKGHVKVPKPTGVKKGWQRAYAVVCDCKLFLYDLPEGKSTQPGVIASQVLDLRDDEFSVSSVLASDVIHATRRDIPCIFRVTASLLGAPSKTSSLLILTENENEKRKWVGILEGLQSILHKNRLRNQVVHVPLEAYDSSLPLIKAILTAAIVDADRIAVGLEEGLYVIEVTRDVIVRAADCKKVHQIELAPREKIVILLCGRNHHVHLYPWSSLDGAEGSFDIKLPETKGCQLMATATLKRNSGTCLFVAVKRLILCYEIQRTKPFHRKFNEIVAPGSVQCLAVLRDRLCVGYPSGFCLLSIQGDGQPLNLVNPNDPSLAF

SEQ ID NO: 13378 - protein, 129 aa, Homo sapiens
  Payload ID: 2601
  Gene Symbol: CDC42BPB
  Gene Name: CDC42 binding protein kinase beta (DMPK-like)
  ENSP ID: ENSP00000489452
TACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVGIFVGDFPFGFGFGI

SEQ ID NO: 13379 - protein, 1551 aa, Homo sapiens
  Payload ID: 2602
  Gene Symbol: CDC42BPG
  Gene Name: CDC42 binding protein kinase gamma (DMPK-like)
  Uniprot ID: Q6DT37
  ENSP ID: ENSP00000345133
MERRLRALEQLARGEAGGCPGLDGLLDLLLALHHELSSGPLRRERSVAQFLSWASPFVSKVKELRLQRDDFEILKVIGRGAFGEVTVVRQRDTGQIFAMKMLHKWEMLKRAETACFREERDVLVKGDSRWVTTLHYAFQDEEYLYLVMDYYAGGDLLTLLSRFEDRLPPELAQFYLAEMVLAIHSLHQLGYVHRDVKPDNVLLDVNGHIRLADFGSCLRLNTNGMVDSSVAVGTPDYISPEILQAMEEGKGHYGPQCDWWSLGVCAYELLFGETPFYAESLVETYGKIMNHEDHLQFPPDVPDVPASAQDLIRQLLCRQEERLGRGGLDDFRNHPFFEGVDWERLASSTAPYIPELRGPMDTSNFDVDDDTLNHPGTLPPPSHGAFSGHHLPFVGFTYTSGSHSPESSSEAWAALERKLQCLEQEKVELSRKHQEALHAPTDHRELEQLRKEVQTLRDRLPEMLRDKASLSQTDGPPAGSPGQDSDLRQELDRLHRELAEGRAGLQAQEQELCRAQGQQEELLQRLQEAQEREAATASQTRALSSQLEEARAAQRELEAQVSSLSRQVTQLQGQWEQRLEESSQAKTIHTASETNGMGPPEGGPQEAQLRKEVAALREQLEQAHSHRPSGKEEALCQLQEENRRLSREQERLEAELAQEQESKQRLEGERRETESNWEAQLADILSWVNDEKVSRGYLQALATKMAEELESLRNVGTQTLPARPLDHQWKARRLQKMEASARLELQSALEAEIRAKQGLQERLTQVQEAQLQAERRLQEAEKQSQALQQELAMLREELRARGPVDTKPSNSLIPFLSFRSSEKDSAKDPGISGEATRHGGEPDLRPEGRRSLRMGAVFPRAPTANTASTEGLPAKPGSHTLRPRSFPSPTKCLRCTSLMLGLGRQGLGCDACGYFCHTTCAPQAPPCPVPPDLLRTALGVHPETGTGTAYEGFLSVPRPSGVRRGWQRVFAALSDSRLLLFDAPDLRLSPPSGALLQVLDLRDPQFSATPVLASDVIHAQSRDLPRIFRVTTSQLAVPPTTCTVLLLAESEGERERWLQVLGELQRLLLDARPRPRPVYTLKEAYDNGLPLLPHTLCAAILDQDRLALGTEEGLFVIHLRSNDIFQVGECRRVQQLTLSPSAGLLVVLCGRGPSVRLFALAELENIEVAGAKIPESRGCQVLAAGSILQARTPVLCVAVKRQVLCYQLGPGPGPWQRRIRELQAPATVQSLGLLGDRLCVGAAGGFALYPLLNEAAPLALGAGLVPEELPPSRGGLGEALGAVELSLSEFLLLFTTAGIYVDGAGRKSRGHELLWPAAPMGWGYAAPYLTVFSENSIDVFDVRRAEWVQTVPLKKVRPLNPEGSLFLYGTEKVRLTYLRNQLAEKDEFDIPDLTDNSRRQLFRTKSKRRFFFRVSEEQQKQQRREMLKDPFVRSKLISPPTNFNHLVHVGPANGRPGARDKSPAPEEKGRVARGSGPQRPHSFSEALRRPASMGSEGLGGDADPMKRKPWTSLSSESVSCPQGSLSPATSLMQVSERPRSLPLSPELESSP

SEQ ID NO: 13380 - protein, 391 aa, Homo sapiens
  Payload ID: 2603
  Gene Symbol: CDC42EP1
  Gene Name: CDC42 effector protein (Rho GTPase binding) 1
  Uniprot ID: Q00587
  ENSP ID: ENSP00000249014
MPGPQGGRGAATMSLGKLSPVGWVSSSQGKRRLTADMISHPLGDFRHTMHVGRGGDVFGDTSFLSNHGGSSGSTHRSPRSFLAKKLQLVRRVGAPPRRMASPPAPSPAPPAISPIIKNAISLPQLNQAAYDSLVVGKLSFDSSPTSSTDGHSSYGLDSGFCTISRLPRSEKPHDRDRDGSFPSEPGLRRSDSLLSFRLDLDLGPSLLSELLGVMSLPEAPAAETPAPAANPPAPTANPTGPAANPPATTANPPAPAANPSAPAATPTGPAANPPAPAASSTPHGHCPNGVTAGLGPVAEVKSSPVGGGPRGPAGPALGRHWGAGWDGGHHYPEMDARQERVEVLPQARASWESLDEEWRAPQAGSRTPVPSTVQANTFEFADAEEDDEVKV

SEQ ID NO: 13381 - protein, 48 aa, Homo sapiens
  Payload ID: 2603
  Gene Symbol: CDC42EP1
  Gene Name: CDC42 effector protein (Rho GTPase binding) 1
  ENSP ID: ENSP00000403710
MPGPQGGRGAATMSLGKLSPVGWVSSSQGKRRLTADMISHPLGDFRHT

SEQ ID NO: 13382 - protein, 60 aa, Homo sapiens
  Payload ID: 2603
  Gene Symbol: CDC42EP1
  Gene Name: CDC42 effector protein (Rho GTPase binding) 1
  ENSP ID: ENSP00000405006
MPGPQGGRGAATMSLGKLSPVGWVSSSQGKRRLTADMISHPLGDFRHTMHVGRGGDVFGD

SEQ ID NO: 13383 - protein, 70 aa, Homo sapiens
  Payload ID: 2603
  Gene Symbol: CDC42EP1
  Gene Name: CDC42 effector protein (Rho GTPase binding) 1
  ENSP ID: ENSP00000411682
MPGPQGGRGAATMSLGKLSPVGWVSSSQGKRRLTADMISHPLGDFRHTMHVGRGGDVFGDTSFLSNHGGS

SEQ ID NO: 13384 - protein, 210 aa, Homo sapiens
  Payload ID: 2604
  Gene Symbol: CDC42EP2
  Gene Name: CDC42 effector protein (Rho GTPase binding) 2
  Uniprot ID: O14613
  ENSP ID: ENSP00000279249
MSTKVPIYLKRGSRKGKKEKLRDLLSSDMISPPLGDFRHTIHIGSGGGSDMFGDISFLQGKFHLLPGTMVEGPEEDGTFDLPFQFTRTATVCGRELPDGPSPLLKNAISLPVIGGPQALTLPTAQAPPKPPRLHLETPQPSPQEGGSVDIWRIPETGSPNSGLTPESGAEEPFLSNASSLLSLHVDLGPSILDDVLQIMDQDLDSMQIPT

SEQ ID NO: 13385 - protein, 210 aa, Homo sapiens; identical to SEQ ID NO: 13384
  Payload ID: 2604
  Gene Symbol: CDC42EP2
  Gene Name: CDC42 effector protein (Rho GTPase binding) 2
  Uniprot ID: O14613
  ENSP ID: ENSP00000431660

SEQ ID NO: 13386 - protein, 254 aa, Homo sapiens
  Payload ID: 2605
  Gene Symbol: CDC42EP3
  Gene Name: CDC42 effector protein (Rho GTPase binding) 3
  Uniprot ID: Q9UKI2
  ENSP ID: ENSP00000295324
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 13387 - protein, 34 aa, Homo sapiens
  Payload ID: 2605
  Gene Symbol: CDC42EP3
  Gene Name: CDC42 effector protein (Rho GTPase binding) 3
  ENSP ID: ENSP00000398062
MPAKTPIYLKAANNKKGKKFKLRDILSPDMISPP

SEQ ID NO: 13388 - protein, 215 aa, Homo sapiens
  Payload ID: 2605
  Gene Symbol: CDC42EP3
  Gene Name: CDC42 effector protein (Rho GTPase binding) 3
  ENSP ID: ENSP00000403298
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIK

SEQ ID NO: 13389 - protein, 14 aa, Homo sapiens
  Payload ID: 2605
  Gene Symbol: CDC42EP3
  Gene Name: CDC42 effector protein (Rho GTPase binding) 3
  ENSP ID: ENSP00000409147
MPAKTPIYLKAANN

SEQ ID NO: 13390 - protein, 254 aa, Homo sapiens; identical to SEQ ID NO: 13386
  Payload ID: 2605
  Gene Symbol: CDC42EP3
  Gene Name: CDC42 effector protein (Rho GTPase binding) 3
  Uniprot ID: Q9UKI2
  ENSP ID: ENSP00000480549

SEQ ID NO: 13391 - protein, 356 aa, Homo sapiens
  Payload ID: 2606
  Gene Symbol: CDC42EP4
  Gene Name: CDC42 effector protein (Rho GTPase binding) 4
  Uniprot ID: Q9H3Q1
  ENSP ID: ENSP00000338258
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 13392 - protein, 286 aa, Homo sapiens
  Payload ID: 2606
  Gene Symbol: CDC42EP4
  Gene Name: CDC42 effector protein (Rho GTPase binding) 4
  Uniprot ID: Q9H3Q1
  ENSP ID: ENSP00000404270
MPILKQLVSSSVHSKRRSRADLTAEMISAPLGDFRHTMHVGRAGDAFGDTSFLNSKAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 13393 - protein, 127 aa, Homo sapiens
  Payload ID: 2606
  Gene Symbol: CDC42EP4
  Gene Name: CDC42 effector protein (Rho GTPase binding) 4
  ENSP ID: ENSP00000462231
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEA

SEQ ID NO: 13394 - protein, 73 aa, Homo sapiens
  Payload ID: 2606
  Gene Symbol: CDC42EP4
  Gene Name: CDC42 effector protein (Rho GTPase binding) 4
  ENSP ID: ENSP00000463877
MPILKQLVSSSVHSKRRSRADLTAEMISAPLGDFRHTMHVGRAGDAFGDTSFLNSKAGEPDGESLDEQPSSSS

SEQ ID NO: 13395 - protein, 79 aa, Homo sapiens
  Payload ID: 2606
  Gene Symbol: CDC42EP4
  Gene Name: CDC42 effector protein (Rho GTPase binding) 4
  ENSP ID: ENSP00000464104
MPILKQLVSSSVHSKRRSRADLTAEMISAPLGDFRHTMHQLPLQLHLRHPGGAQPCLPGAGQGPGCCLKTARQGVLLHG

SEQ ID NO: 13396 - protein, 79 aa, Homo sapiens; identical to SEQ ID NO: 13395
  Payload ID: 2606
  Gene Symbol: CDC42EP4
  Gene Name: CDC42 effector protein (Rho GTPase binding) 4
  ENSP ID: ENSP00000485861

SEQ ID NO: 13397 - protein, 148 aa, Homo sapiens
  Payload ID: 2607
  Gene Symbol: CDC42EP5
  Gene Name: CDC42 effector protein (Rho GTPase binding) 5
  Uniprot ID: Q6NZY7
  ENSP ID: ENSP00000301200
MPVLKQLGPAQPKKRPDRGALSISAPLGDFRHTLHVGRGGDAFGDTSFLSRHGGGPPPEPRAPPAGAPRSPPPPAVPQSAAPSPADPLLSFHLDLGPSMLDAVLGVMDAARPEAAAAKPDAEPRPGTQPPQARCRPNADLELNDVIGL

SEQ ID NO: 13398 - protein, 148 aa, Homo sapiens; identical to SEQ ID NO: 13397
  Payload ID: 2607
  Gene Symbol: CDC42EP5
  Gene Name: CDC42 effector protein (Rho GTPase binding) 5
  Uniprot ID: Q6NZY7
  ENSP ID: ENSP00000479726

SEQ ID NO: 13399 - protein, 17 aa, Homo sapiens
  Payload ID: 2607
  Gene Symbol: CDC42EP5
  Gene Name: CDC42 effector protein (Rho GTPase binding) 5
  ENSP ID: ENSP00000483465
MPVLKQLGPAQPKKRPD

SEQ ID NO: 13400 - protein, 148 aa, Homo sapiens; identical to SEQ ID NO: 13397
  Payload ID: 2607
  Gene Symbol: CDC42EP5
  Gene Name: CDC42 effector protein (Rho GTPase binding) 5
  Uniprot ID: Q6NZY7
  ENSP ID: ENSP00000484158

SEQ ID NO: 13401 - protein, 17 aa, Homo sapiens
  Payload ID: 2607
  Gene Symbol: CDC42EP5
  Gene Name: CDC42 effector protein (Rho GTPase binding) 5
  ENSP ID: ENSP00000484979
MPVLKQLGPAQPKKRPD

SEQ ID NO: 13402 - protein, 148 aa, Homo sapiens; identical to SEQ ID NO: 13397
  Payload ID: 2607
  Gene Symbol: CDC42EP5
  Gene Name: CDC42 effector protein (Rho GTPase binding) 5
  Uniprot ID: Q6NZY7
  ENSP ID: ENSP00000484985

SEQ ID NO: 13403 - protein, 516 aa, Homo sapiens
  Payload ID: 2608
  Gene Symbol: ARHGEF9
  Gene Name: Cdc42 guanine nucleotide exchange  factor (GEF) 9
  Uniprot ID: O43307
  ENSP ID: ENSP00000253401
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 13404 - protein, 564 aa, Homo sapiens
  Payload ID: 2608
  Gene Symbol: ARHGEF9
  Gene Name: Cdc42 guanine nucleotide exchange  factor (GEF) 9
  ENSP ID: ENSP00000364004
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRYCEGIKKPNRSKGVSDYDDAGVDFCSGNILHSGCFFYHWGFPCCSTSGSLQFCI

SEQ ID NO: 13405 - protein, 495 aa, Homo sapiens
  Payload ID: 2608
  Gene Symbol: ARHGEF9
  Gene Name: Cdc42 guanine nucleotide exchange  factor (GEF) 9
  ENSP ID: ENSP00000364006
MANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 13406 - protein, 487 aa, Homo sapiens
  Payload ID: 2608
  Gene Symbol: ARHGEF9
  Gene Name: Cdc42 guanine nucleotide exchange  factor (GEF) 9
  ENSP ID: ENSP00000364012
MQWIRGGSGMLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKLPFPQLSEARICSPKGFASVFNGTCCGES

SEQ ID NO: 13407 - protein, 483 aa, Homo sapiens
  Payload ID: 2608
  Gene Symbol: ARHGEF9
  Gene Name: Cdc42 guanine nucleotide exchange  factor (GEF) 9
  ENSP ID: ENSP00000399994
MQWIRGGSGMLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGGTGEGEIEFVGFFAGPTPA

SEQ ID NO: 13408 - protein, 110 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485083
MRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLM

SEQ ID NO: 13409 - protein, 91 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485086
  MOD_RES (1)..(1): Any amino acid
XVMRNVTQQINERKRRLENIDKIAQWQASVLDWEGEDILDRSSELIYTGEMAWIYQPYGRNQQRVFFLFDHQMVLCKKALKFLKTRRGRLQ

SEQ ID NO: 13410 - protein, 495 aa, Homo sapiens; identical to SEQ ID NO: 13405
  Payload ID: 2608
  Gene Symbol: ARHGEF9
  Gene Name: Cdc42 guanine nucleotide exchange  factor (GEF) 9
  ENSP ID: ENSP00000485144

SEQ ID NO: 13411 - protein, 108 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485160
MRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSK

SEQ ID NO: 13412 - protein, 42 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485282
MANRELAFKAGDVIKVLDASNKDWWWGQIDDEEGWFPASFVR

SEQ ID NO: 13413 - protein, 115 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485327
MANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKR

SEQ ID NO: 13414 - protein, 463 aa, Homo sapiens
  Payload ID: 2608
  Gene Symbol: ARHGEF9
  Gene Name: Cdc42 guanine nucleotide exchange  factor (GEF) 9
  Uniprot ID: O43307
  ENSP ID: ENSP00000485369
MQWIRGGSGMLWVNQEDEVEEGPSDVQNGHLDPNSDCLCLGRPLQNRDQMRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 13415 - protein, 134 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485559
MANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEGYLKQCRKRRDMFSDEQLKVIFGNIEDI

SEQ ID NO: 13416 - protein, 414 aa, Homo sapiens
  Payload ID: 2608
  Gene Symbol: ARHGEF9
  Gene Name: Cdc42 guanine nucleotide exchange  factor (GEF) 9
  Uniprot ID: O43307
  ENSP ID: ENSP00000485626
MRANVINEIMSTERHYIKHLKDICEGYLKQCRKRRDMFSDEQLKVIFGNIEDIYRFQMGFVRDLEKQYNNDDPHLSEIGPCFLEHQDGFWIYSEYCNNHLDACMELSKLMKDSRYQHFFEACRLLQQMIDIAIDGFLLTPVQKICKYPLQLAELLKYTAQDHSDYRYVAAALAVMRNVTQQINERKRRLENIDKIAQWQASVLDWEGEDILDRSSELIYTGEMAWIYQPYGRNQQRVFFLFDHQMVLCKKDLIRRDILYYKGRIDMDKYEVVDIEDGRDDDFNVSMKNAFKLHNKETEEIHLFFAKKLEEKIRWLRAFREERKMVQEDEKIGFEISENQKRQAAMTVRKVPKQKGVNSARSVPPSYPPPQDPLNHGQYLVPDGIAQSQVFEFTEPKRSQSPFWQNFSRLTPFKK

SEQ ID NO: 13417 - protein, 136 aa, Homo sapiens
  Payload ID: 2608
  Gene Symbol: ARHGEF9
  Gene Name: Cdc42 guanine nucleotide exchange  factor (GEF) 9
  ENSP ID: ENSP00000485633
MTLLITGDSIVSAEAVWDHVTMANRELAFKAGDVIKVLDASNKDWWWGQIDDEEGWFPASFVRLWVNQEDEVEEGPSDVQNGHLDPNSDCLCLGRPLQNRDQMRANVINEIMSTERHYIKHLKDICEKVGGDMILL

SEQ ID NO: 13418 - protein, 79 aa, Homo sapiens
  Payload ID: 2609
  Gene Symbol: CDC42SE1
  Gene Name: CDC42 small effector 1
  Uniprot ID: Q9NRR8
  ENSP ID: ENSP00000349773
MSEFWHKLGCCVVEKPQPKKKRRRIDRTMIGEPMNFVHLTHIGSGEMGAGDGLAMTGAVQEQMRSKGNRDRPWSNSRGL

SEQ ID NO: 13419 - protein, 79 aa, Homo sapiens; identical to SEQ ID NO: 13418
  Payload ID: 2609
  Gene Symbol: CDC42SE1
  Gene Name: CDC42 small effector 1
  Uniprot ID: Q9NRR8
  ENSP ID: ENSP00000445647

SEQ ID NO: 13420 - protein, 79 aa, Homo sapiens; identical to SEQ ID NO: 13418
  Payload ID: 2609
  Gene Symbol: CDC42SE1
  Gene Name: CDC42 small effector 1
  Uniprot ID: Q9NRR8
  ENSP ID: ENSP00000475845

SEQ ID NO: 13421 - protein, 84 aa, Homo sapiens
  Payload ID: 2610
  Gene Symbol: CDC42SE2
  Gene Name: CDC42 small effector 2
  Uniprot ID: Q9NRR3
  ENSP ID: ENSP00000353706
MSEFWLCFNCCIAEQPQPKRRRRIDRSMIGEPTNFVHTAHVGSGDLFSGMNSVSSIQNQMQSKGGYGGGMPANVQMQLVDTKAG

SEQ ID NO: 13422 - protein, 84 aa, Homo sapiens; identical to SEQ ID NO: 13421
  Payload ID: 2610
  Gene Symbol: CDC42SE2
  Gene Name: CDC42 small effector 2
  Uniprot ID: Q9NRR3
  ENSP ID: ENSP00000378667

SEQ ID NO: 13423 - protein, 54 aa, Homo sapiens
  Payload ID: 2610
  Gene Symbol: CDC42SE2
  Gene Name: CDC42 small effector 2
  ENSP ID: ENSP00000425292
HVGSGDLFSGMNSPSRTFCSEDSHIQLWEIIISLIIPSTFEDYQISQQQYCGLE

SEQ ID NO: 13424 - protein, 57 aa, Homo sapiens
  Payload ID: 2610
  Gene Symbol: CDC42SE2
  Gene Name: CDC42 small effector 2
  ENSP ID: ENSP00000426779
MIGEPTNFVHTAHVGSGDLFSGMNSVSSIQNQMQSKGGYGGGMPANVQMQLVDTKAG

SEQ ID NO: 13425 - protein, 84 aa, Homo sapiens; identical to SEQ ID NO: 13421
  Payload ID: 2610
  Gene Symbol: CDC42SE2
  Gene Name: CDC42 small effector 2
  Uniprot ID: Q9NRR3
  ENSP ID: ENSP00000427421

SEQ ID NO: 13426 - protein, 484 aa, Homo sapiens
  Payload ID: 2611
  Gene Symbol: CLK1
  Gene Name: CDC-like kinase 1
  Uniprot ID: P49759
  ENSP ID: ENSP00000326830
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 13427 - protein, 307 aa, Homo sapiens
  Payload ID: 2611
  Gene Symbol: CLK1
  Gene Name: CDC-like kinase 1
  ENSP ID: ENSP00000386358
MHLSNRGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 13428 - protein, 355 aa, Homo sapiens
  Payload ID: 2611
  Gene Symbol: CLK1
  Gene Name: CDC-like kinase 1
  ENSP ID: ENSP00000386875
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILDTR

SEQ ID NO: 13429 - protein, 526 aa, Homo sapiens
  Payload ID: 2611
  Gene Symbol: CLK1
  Gene Name: CDC-like kinase 1
  Uniprot ID: P49759
  ENSP ID: ENSP00000394734
MAAGRRPASALWPERRGSPLRGDLLGFQNVREPSSCGETLSGMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 13430 - protein, 136 aa, Homo sapiens
  Payload ID: 2611
  Gene Symbol: CLK1
  Gene Name: CDC-like kinase 1
  Uniprot ID: P49759
  ENSP ID: ENSP00000400487
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGMKLLIL

SEQ ID NO: 13431 - protein, 454 aa, Homo sapiens
  Payload ID: 2611
  Gene Symbol: CLK1
  Gene Name: CDC-like kinase 1
  ENSP ID: ENSP00000479484
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGDEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 13432 - protein, 497 aa, Homo sapiens
  Payload ID: 2612
  Gene Symbol: CLK2
  Gene Name: CDC-like kinase 2
  ENSP ID: ENSP00000347759
MPHPRRYHSSERGSRGSYREHYRSRKHKRRRSRSWSSSSDRTRRRRREDSYHVRSRSYDDRSSDRRVYDRRYCGSYRRNDYSRDRGDAYYDTDYRHSYEYQRENSSYRSQRSSRRKHRRRRRRSRTFSRSSSHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 13433 - protein, 498 aa, Homo sapiens
  Payload ID: 2612
  Gene Symbol: CLK2
  Gene Name: CDC-like kinase 2
  Uniprot ID: P49760
  ENSP ID: ENSP00000354856
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 13434 - protein, 499 aa, Homo sapiens
  Payload ID: 2612
  Gene Symbol: CLK2
  Gene Name: CDC-like kinase 2
  Uniprot ID: P49760
  ENSP ID: ENSP00000357345
MPHPRRYHSSERGSRGSYREHYRSRKHKRRRSRSWSSSSDRTRRRRREDSYHVRSRSSYDDRSSDRRVYDRRYCGSYRRNDYSRDRGDAYYDTDYRHSYEYQRENSSYRSQRSSRRKHRRRRRRSRTFSRSSSQHSSRRAKSVEDDAEGHLIYHVGDWLQERYEIVSTLGEGTFGRVVQCVDHRRGGARVALKIIKNVEKYKEAARLEINVLEKINEKDPDNKNLCVQMFDWFDYHGHMCISFELLGLSTFDFLKDNNYLPYPIHQVRHMAFQLCQAVKFLHDNKLTHTDLKPENILFVNSDYELTYNLEKKRDERSVKSTAVRVVDFGSATFDHEHHSTIVSTRHYRAPEVILELGWSQPCDVWSIGCIIFEYYVGFTLFQTHDNREHLAMMERILGPIPSRMIRKTRKQKYFYRGRLDWDENTSAGRYVRENCKPLRRYLTSEAEEHHQLFDLIESMLEYEPAKRLTLGEALQHPFFARLRAEPPNKLWDSSRDISR

SEQ ID NO: 13435 - protein, 497 aa, Homo sapiens; identical to SEQ ID NO: 13432
  Payload ID: 2612
  Gene Symbol: CLK2
  Gene Name: CDC-like kinase 2
  ENSP ID: ENSP00000458788

SEQ ID NO: 13436 - protein, 498 aa, Homo sapiens; identical to SEQ ID NO: 13433
  Payload ID: 2612
  Gene Symbol: CLK2
  Gene Name: CDC-like kinase 2
  Uniprot ID: P49760
  ENSP ID: ENSP00000459461

SEQ ID NO: 13437 - protein, 499 aa, Homo sapiens; identical to SEQ ID NO: 13434
  Payload ID: 2612
  Gene Symbol: CLK2
  Gene Name: CDC-like kinase 2
  Uniprot ID: P49760
  ENSP ID: ENSP00000460443

SEQ ID NO: 13438 - protein, 490 aa, Homo sapiens
  Payload ID: 2613
  Gene Symbol: CLK3
  Gene Name: CDC-like kinase 3
  Uniprot ID: P49761
  ENSP ID: ENSP00000344112
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 13439 - protein, 638 aa, Homo sapiens
  Payload ID: 2613
  Gene Symbol: CLK3
  Gene Name: CDC-like kinase 3
  Uniprot ID: P49761
  ENSP ID: ENSP00000378505
MPVLSARRRELADHAGSGRRSGPSPTARSGPHLSALRAQPARAAHLSGRGTYVRRDTAGGGPGQARPLGPPGTSLLGRGARRSGEGWCPGAFESGARAARPPSRVEPRLATAASREGAGLPRAEVAAGSGRGARSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLMRRMLEFDPAQRITLAEALLHPFFAGLTPEERSFHTSRNPSR

SEQ ID NO: 13440 - protein, 152 aa, Homo sapiens
  Payload ID: 2613
  Gene Symbol: CLK3
  Gene Name: CDC-like kinase 3
  Uniprot ID: P49761
  ENSP ID: ENSP00000431825
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSMRLWGTWVKAPLARWWSAWTMPEGSLRLP

SEQ ID NO: 13441 - protein, 59 aa, Homo sapiens
  Payload ID: 2613
  Gene Symbol: CLK3
  Gene Name: CDC-like kinase 3
  ENSP ID: ENSP00000454785
  MOD_RES (1)..(1): Any amino acid
XAFELLGKNTFEFLKENNFQPYPLPHVRHMAYQLCHALRWPCKLCSWCREEGTTSRLLL

SEQ ID NO: 13442 - protein, 193 aa, Homo sapiens
  Payload ID: 2613
  Gene Symbol: CLK3
  Gene Name: CDC-like kinase 3
  ENSP ID: ENSP00000454961
EHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKVSFWLPPAELMPRRDPRHWADIQQRQARPLKAASLIQLYGRRHPRLLGAGNGASCKLPQRGP

SEQ ID NO: 13443 - protein, 306 aa, Homo sapiens
  Payload ID: 2613
  Gene Symbol: CLK3
  Gene Name: CDC-like kinase 3
  ENSP ID: ENSP00000455762
SGRGARSGEWGLAAAGAWETMHHCKRYRSPEPDPYLSYRWKRRRSYSREHEGRLRYPSRREPPPRRSRSRSKDPADQRPHPPFGSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALR

SEQ ID NO: 13444 - protein, 145 aa, Homo sapiens
  Payload ID: 2613
  Gene Symbol: CLK3
  Gene Name: CDC-like kinase 3
  ENSP ID: ENSP00000455905
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSMRLWGTWVKAPLARWWSAWTMP

SEQ ID NO: 13445 - protein, 190 aa, Homo sapiens
  Payload ID: 2613
  Gene Symbol: CLK3
  Gene Name: CDC-like kinase 3
  ENSP ID: ENSP00000456202
MSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGG

SEQ ID NO: 13446 - protein, 173 aa, Homo sapiens
  Payload ID: 2613
  Gene Symbol: CLK3
  Gene Name: CDC-like kinase 3
  ENSP ID: ENSP00000456278
GSGRGARSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSMRLWGTWVKAPLARWWSAWTMPEGSLRLP

SEQ ID NO: 13447 - protein, 117 aa, Homo sapiens
  Payload ID: 2613
  Gene Symbol: CLK3
  Gene Name: CDC-like kinase 3
  ENSP ID: ENSP00000456399
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRS

SEQ ID NO: 13448 - protein, 70 aa, Homo sapiens
  Payload ID: 2613
  Gene Symbol: CLK3
  Gene Name: CDC-like kinase 3
  ENSP ID: ENSP00000456431
  MOD_RES (1)..(1): Any amino acid
XLPQTHENREHLVMMEKILGPIPSHMIHRTRKQKYFYKGGLVWDENSSDGRYVKENCKPLKNISSTEEWI

SEQ ID NO: 13449 - protein, 19 aa, Homo sapiens
  Payload ID: 2613
  Gene Symbol: CLK3
  Gene Name: CDC-like kinase 3
  ENSP ID: ENSP00000457362
MSDWFNFHGHMCIAFELLG

SEQ ID NO: 13450 - protein, 224 aa, Homo sapiens
  Payload ID: 2613
  Gene Symbol: CLK3
  Gene Name: CDC-like kinase 3
  ENSP ID: ENSP00000457696
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSD

SEQ ID NO: 13451 - protein, 160 aa, Homo sapiens
  Payload ID: 2613
  Gene Symbol: CLK3
  Gene Name: CDC-like kinase 3
  ENSP ID: ENSP00000457936
  MOD_RES (1)..(1): Any amino acid
XSGEWGLAAAGAWETMHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSREVSGCPEDHPQRGQVPGGCPA

SEQ ID NO: 13452 - protein, 239 aa, Homo sapiens
  Payload ID: 2613
  Gene Symbol: CLK3
  Gene Name: CDC-like kinase 3
  ENSP ID: ENSP00000458099
MHHCKRYRSPEPDPYLSYRWKRRRSYSREHEGRLRYPSRREPPPRRSRSRSHDRLPYQRRYRERRDSDTYRCEERSPSFGEDYYGPSRSRHRRRSRERGPYRTRKHAHHCHKRRTRSCSSASSRSQQSSKRSSRSVEDDKEGHLVCRIGDWLQERYEIVGNLGEGTFGKVVECLDHARGKSQVALKIIRNVGKYREAARLEINVLKKIKEKDKENKFLCVLMSDWFNFHGHMCIAFELL

SEQ ID NO: 13453 - protein, 481 aa, Homo sapiens
  Payload ID: 2614
  Gene Symbol: CLK4
  Gene Name: CDC-like kinase 4
  Uniprot ID: Q9HAZ1
  ENSP ID: ENSP00000316948
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDERTLKNTDIKVVDFGSATYDDEHHSTLVSTRHYRAPEVILALGWSQPCDVWSIGCILIEYYLGFTVFQTHDSKEHLAMMERILGPIPQHMIQKTRKRKYFHHNQLDWDEHSSAGRYVRRRCKPLKEFMLCHDEEHEKLFDLVRRMLEYDPTQRITLDEALQHPFFDLLKKK

SEQ ID NO: 13454 - protein, 53 aa, Homo sapiens
  Payload ID: 2614
  Gene Symbol: CLK4
  Gene Name: CDC-like kinase 4
  ENSP ID: ENSP00000428651
MRHSKRTHCPDWDSRESWGHESYRGSHKRKRRSHSSTQENRHCKPHHQFKESD

SEQ ID NO: 13455 - protein, 143 aa, Homo sapiens
  Payload ID: 2614
  Gene Symbol: CLK4
  Gene Name: CDC-like kinase 4
  ENSP ID: ENSP00000429195
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSMKSWTLWVKEPLAKL

SEQ ID NO: 13456 - protein, 89 aa, Homo sapiens
  Payload ID: 2614
  Gene Symbol: CLK4
  Gene Name: CDC-like kinase 4
  ENSP ID: ENSP00000430216
MRHSKRTHCPDWDSRESWGHESYRGSHKRKRRSHSSTQENRHCKPHHQFKESDWTCVDIKTNALTLIRLGYLKGYSEIFTGHSVDILKN

SEQ ID NO: 13457 - protein, 54 aa, Homo sapiens
  Payload ID: 2614
  Gene Symbol: CLK4
  Gene Name: CDC-like kinase 4
  ENSP ID: ENSP00000430892
MRHSKRTHCPDWDSRESWGHESYRGSHKRKRRSHSSTQENRHCKPHHQFKESDW

SEQ ID NO: 13458 - protein, 373 aa, Homo sapiens
  Payload ID: 2614
  Gene Symbol: CLK4
  Gene Name: CDC-like kinase 4
  ENSP ID: ENSP00000479788
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDEHSSAGRYVRRRCKPLKEFMLCHDEEHEKLFDLVRRMLEYDPTQRITLDEALQHPFFDLLKKK

SEQ ID NO: 13459 - protein, 373 aa, Homo sapiens [sequence omitted]

SEQ ID NO: 13460 - protein, 108 aa, Homo sapiens
  Payload ID: 2615
  Gene Symbol: CISD1
  Gene Name: CDGSH iron sulfur domain 1
  Uniprot ID: Q9NZ45
  ENSP ID: ENSP00000363041
MSLTSSSSVRVEWIAAVTIAAGTAAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 13461 - protein, 135 aa, Homo sapiens
  Payload ID: 2616
  Gene Symbol: CISD2
  Gene Name: CDGSH iron sulfur domain 2
  Uniprot ID: Q8N5K1
  ENSP ID: ENSP00000273986
MVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 13462 - protein, 145 aa, Homo sapiens
  Payload ID: 2616
  Gene Symbol: CISD2
  Gene Name: CDGSH iron sulfur domain 2
  ENSP ID: ENSP00000423716
MPQGLLSSELSPVSFRGKIPGFCREGAELGTGQSLSSPVLLIALFSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 13463 - protein, 47 aa, Homo sapiens
  Payload ID: 2616
  Gene Symbol: CISD2
  Gene Name: CDGSH iron sulfur domain 2
  ENSP ID: ENSP00000458976
MVLESVARIVKVQLPAYLKRLPVPESITGFARLTESCSCHPGWSAMA

SEQ ID NO: 13464 - protein, 127 aa, Homo sapiens
  Payload ID: 2617
  Gene Symbol: CISD3
  Gene Name: CDGSH iron sulfur domain 3
  Uniprot ID: P0C7P0
  ENSP ID: ENSP00000483781
MRGAGAILRPAARGARDLNPRRDISSWLAQWFPRTPARSVVALKTPIKVELVAGKTYRWCVCGRSKKQPFCDGSHFFQRTGLSPLKFKAQETRMVALCTCKATQRPPYCDGTHRSERVQKAEVGSPL

SEQ ID NO: 13465 - protein, 127 aa, Homo sapiens; identical to SEQ ID NO: 13464
  Payload ID: 2617
  Gene Symbol: CISD3
  Gene Name: CDGSH iron sulfur domain 3
  Uniprot ID: P0C7P0
  ENSP ID: ENSP00000484950

SEQ ID NO: 13466 - protein, 369 aa, Homo sapiens
  Payload ID: 2618
  Gene Symbol: CACUL1
  Gene Name: CDK2-associated, cullin domain 1
  Uniprot ID: Q86Y37
  ENSP ID: ENSP00000358147
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPEWVQMAPTLFSKFIPNILPPAVESELSEYAAQDQKFQRELIQNGFTRGDQSRKRAGDELAYNSSSACASSRGYR

SEQ ID NO: 13467 - protein, 303 aa, Homo sapiens
  Payload ID: 2618
  Gene Symbol: CACUL1
  Gene Name: CDK2-associated, cullin domain 1
  Uniprot ID: Q86Y37
  ENSP ID: ENSP00000431329
MEESMEEEEGGSYEAMMDDQNHNNWEAAVDGFRQPLPPPPPPSSIPAPAREPPGGQLLAVPAVSVDRKGPKEGLPMGPQPPPEANGVIMMLKSCDAAAAVAKAAPAPTASSTININTSTSKFLMNVITIEDYKSTYWPKLDGAIDQLLTQSPGDYIPISYEQIYSCVYKCVCQQHSEQMYSDLIKKITNHLERVSKELQASPPDLYIERFNIALGQYMGALQSIVPLFIYMNKFYIETKLNRDLKDDLIKLFTEHVAEKHIYSLMPLLLEAQSTPFQVTPSTMANIVKGLYTLRPVSQNFTAV

SEQ ID NO: 13468 - protein, 633 aa, Homo sapiens
  Payload ID: 2619
  Gene Symbol: CABLES1
  Gene Name: Cdk5 and Abl enzyme substrate 1
  Uniprot ID: Q8TDN4
  ENSP ID: ENSP00000256925
MAAAAAAATTAACSSGSAGTDAAGASGLQQPPPQPQPQPAAAAPAQPPPEPPRKPRMDPRRRQAALSFLTNISLDGRLPPQDAEWGGGEEGGAAKPGAGGACGARTRFSLLAAAERGGCIALAAPGTPAAGLAAGSGPCLPQPSSLPPLIPGGHATVSGPGVARGFASPLGAGRASGEQWQPPRPAPLAACAQLQLLDGSGAAGQEELEEDDAFISVQVPAAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 13469 - protein, 306 aa, Homo sapiens
  Payload ID: 2619
  Gene Symbol: CABLES1
  Gene Name: Cdk5 and Abl enzyme substrate 1
  Uniprot ID: Q8TDN4
  ENSP ID: ENSP00000383321
MRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 13470 - protein, 368 aa, Homo sapiens
  Payload ID: 2619
  Gene Symbol: CABLES1
  Gene Name: Cdk5 and Abl enzyme substrate 1
  Uniprot ID: Q8TDN4
  ENSP ID: ENSP00000413851
MLSKRGCHARIYADFPIRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 13471 - protein, 9 aa, Homo sapiens
  Payload ID: 2619
  Gene Symbol: CABLES1
  Gene Name: Cdk5 and Abl enzyme substrate 1
  ENSP ID: ENSP00000461994
MRQHDTRNG

SEQ ID NO: 13472 - protein, 38 aa, Homo sapiens
  Payload ID: 2619
  Gene Symbol: CABLES1
  Gene Name: Cdk5 and Abl enzyme substrate 1
  ENSP ID: ENSP00000464435
MRQHDTRNGRIVLISGRRSFCSIFSVLPYRDSTQVGQQ

SEQ ID NO: 13473 - protein, 163 aa, Homo sapiens
  Payload ID: 2619
  Gene Symbol: CABLES1
  Gene Name: Cdk5 and Abl enzyme substrate 1
  ENSP ID: ENSP00000476575
  MOD_RES (1)..(1): Any amino acid
XAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGYVYACMLCSSLGEKISHQCT

SEQ ID NO: 13474 - protein, 478 aa, Homo sapiens
  Payload ID: 2620
  Gene Symbol: CABLES2
  Gene Name: Cdk5 and Abl enzyme substrate 2
  Uniprot ID: Q9BTV7
  ENSP ID: ENSP00000279101
MAAAAAGGAPGPAPGPAGPPPPAAPTSAARAPPQALRRRGDSRRRQAALFFLNNISLDGRPPSLGPGGEKPPPPPAEAREPPAPPPPEPPTGLPARTPAPQGLLSPTQVPTGLGLDGQRQRKRVTSQRCSLEFLEDAVGCAPAQRTKHTSGSPRHKGLKKTHFIKNMRQYDTRNSRIVLICAKRSLCAAFSVLPYGEGLRISDLRVDSQKQRHPSGGVSVSSEMVFELEGVELGADGKVVSYAKFLYPTNALVTHKSDSHGLLPTPRPSVPRTLPGSRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVTQLIDKLEERFRFNRRDLIGFEFTVLVALELALYLPENQVLPHYRRLTQQF

SEQ ID NO: 13475 - protein, 258 aa, Homo sapiens
  Payload ID: 2620
  Gene Symbol: CABLES2
  Gene Name: Cdk5 and Abl enzyme substrate 2
  ENSP ID: ENSP00000398535
  MOD_RES (1)..(1): Any amino acid
XHQEQQDRAHLCQAVPVRGLLGPALWGRPADQVVSYAKFLYPTNALVTHKSDSHGLLPTPRPSVPRTLPGSRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVTQLIDKLEERFRFNRRDLIGFEFTVLVALELALYLPE

SEQ ID NO: 13476 - protein, 587 aa, Homo sapiens
  Payload ID: 2621
  Gene Symbol: CDK5RAP1
  Gene Name: CDK5 regulatory subunit associated protein 1
  Uniprot ID: Q96SZ6
  ENSP ID: ENSP00000217372
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 13477 - protein, 510 aa, Homo sapiens
  Payload ID: 2621
  Gene Symbol: CDK5RAP1
  Gene Name: CDK5 regulatory subunit associated protein 1
  Uniprot ID: Q96SZ6
  ENSP ID: ENSP00000341840
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 13478 - protein, 601 aa, Homo sapiens
  Payload ID: 2621
  Gene Symbol: CDK5RAP1
  Gene Name: CDK5 regulatory subunit associated protein 1
  Uniprot ID: Q96SZ6
  ENSP ID: ENSP00000350558
MHPLQCVLQVQRSLGWGPLASVSWLSLRMCRAHSSLSSTMCPSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQVFLPPRPPKVLGLQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 13479 - protein, 256 aa, Homo sapiens
  Payload ID: 2621
  Gene Symbol: CDK5RAP1
  Gene Name: CDK5 regulatory subunit associated protein 1
  ENSP ID: ENSP00000409474
  MOD_RES (1)..(1): Any amino acid
XCMAERLKEEILNREKMVDILAGPDAYRDLPRLLAVAESGQQAANVLLSLDETYADVMPVQTSASATSAFVYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 13480 - protein, 497 aa, Homo sapiens
  Payload ID: 2621
  Gene Symbol: CDK5RAP1
  Gene Name: CDK5 regulatory subunit associated protein 1
  Uniprot ID: Q96SZ6
  ENSP ID: ENSP00000476857
MMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSIMRGCDNMCSYCIVPFTRGRERSRPIASILEEVKKLSEQGLKEVTLLGQNVNSFRDNSEVQFNSAVPTNLSRGFTTNYKTKQGGLRFAHLLDQVSRVDPEMRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 13481 - protein, 579 aa, Homo sapiens
  Payload ID: 2622
  Gene Symbol: CDKAL1
  Gene Name: CDK5 regulatory subunit associated protein 1-like 1
  Uniprot ID: Q5VV42
  ENSP ID: ENSP00000274695
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKIGERQQVLVTEESFDSKFYVAHNQFYEQVLVPKNPAFMGKMVEVDIYESGKHFMKGQPVSDAKVYTPSISKPLAKGEVSGLTKDFRNGLGNQLSSGSHTSAASQCDSASSRMVLPMPRLHQDCALRMSVGLALLGLLFAFFVKVYN

SEQ ID NO: 13482 - protein, 579 aa, Homo sapiens; identical to SEQ ID NO: 13481
  Payload ID: 2622
  Gene Symbol: CDKAL1
  Gene Name: CDK5 regulatory subunit associated protein 1-like 1
  Uniprot ID: Q5VV42
  ENSP ID: ENSP00000367873

SEQ ID NO: 13483 - protein, 97 aa, Homo sapiens
  Payload ID: 2622
  Gene Symbol: CDKAL1
  Gene Name: CDK5 regulatory subunit associated protein 1-like 1
  Uniprot ID: Q5VV42
  ENSP ID: ENSP00000481755
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITGE

SEQ ID NO: 13484 - protein, 1893 aa, Homo sapiens
  Payload ID: 2623
  Gene Symbol: CDK5RAP2
  Gene Name: CDK5 regulatory subunit associated protein 2
  Uniprot ID: Q96SN8
  ENSP ID: ENSP00000343818
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 13485 - protein, 1814 aa, Homo sapiens
  Payload ID: 2623
  Gene Symbol: CDK5RAP2
  Gene Name: CDK5 regulatory subunit associated protein 2
  Uniprot ID: Q96SN8
  ENSP ID: ENSP00000353317
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLRDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 13486 - protein, 1663 aa, Homo sapiens
  Payload ID: 2623
  Gene Symbol: CDK5RAP2
  Gene Name: CDK5 regulatory subunit associated protein 2
  ENSP ID: ENSP00000354065
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREESFSLYSDQTSYLSICLEENNRFQVEHFSQEELKKKVSDLIQLVKELYTDNQHLKKTIFDLSCMGFQGNGFPDRLASTEQTEEAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 13487 - protein, 1287 aa, Homo sapiens
  Payload ID: 2623
  Gene Symbol: CDK5RAP2
  Gene Name: CDK5 regulatory subunit associated protein 2
  ENSP ID: ENSP00000400395
DSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 13488 - protein, 903 aa, Homo sapiens
  Payload ID: 2623
  Gene Symbol: CDK5RAP2
  Gene Name: CDK5 regulatory subunit associated protein 2
  ENSP ID: ENSP00000409941
NMYRLPATQEVVTQLQSQILELQGELKEFKTCNKQLHQKLILAEAVMEGRPTPDKTLLNDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 13489 - protein, 275 aa, Homo sapiens
  Payload ID: 2623
  Gene Symbol: CDK5RAP2
  Gene Name: CDK5 regulatory subunit associated protein 2
  ENSP ID: ENSP00000417925
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETE

SEQ ID NO: 13490 - protein, 749 aa, Homo sapiens
  Payload ID: 2623
  Gene Symbol: CDK5RAP2
  Gene Name: CDK5 regulatory subunit associated protein 2
  ENSP ID: ENSP00000418418
MMDLVLEEDVTVPGTLSGCSGLVPSVPDDLDGINPNAGLGNVLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTETSLTYSYIFMLHTFLGCIFTPFHAPCSFWLARRTRTRSKLGRMTRLIS

SEQ ID NO: 13491 - protein, 460 aa, Homo sapiens
  Payload ID: 2623
  Gene Symbol: CDK5RAP2
  Gene Name: CDK5 regulatory subunit associated protein 2
  ENSP ID: ENSP00000419265
MMDLVLEEDVTVPGTLSGCSGLVPSVPDDLDGINPNAGLGNVLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRGLTLFPGLFLNSWAQVILPPQFLE

SEQ ID NO: 13492 - protein, 133 aa, Homo sapiens
  Payload ID: 2623
  Gene Symbol: CDK5RAP2
  Gene Name: CDK5 regulatory subunit associated protein 2
  ENSP ID: ENSP00000419640
MACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEAL

SEQ ID NO: 13493 - protein, 506 aa, Homo sapiens
  Payload ID: 2624
  Gene Symbol: CDK5RAP3
  Gene Name: CDK5 regulatory subunit associated protein 3
  Uniprot ID: Q96JB5
  ENSP ID: ENSP00000344683
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGFVCESPTEQVLPMLRFVQKRGNSTVYEWRTGTEPSVVERPHLEELPEQVAEDAIDWGDFGVEAVSEGTDSGISAEAAGIDWGIFPESDSKDPGGDGIDWGDDAVALQITVLEAGTQAPEGVARGPDALTLLEYTETRNQFLDELMELEIFLAQRAVELSEEADVLSVSQFQLAPAILQGQTKEKMVTMVSVLEDLIGKLTSLQLQHLFMILASPRYVDRVTEFLQQKLKQSQLLALKKELMVQKQQEALEEQAALEPKLDLLLEKTKELQKLIEADISKRYSGRPVNLMGTSL

SEQ ID NO: 13494 - protein, 531 aa, Homo sapiens
  Payload ID: 2624
  Gene Symbol: CDK5RAP3
  Gene Name: CDK5 regulatory subunit associated protein 3
  Uniprot ID: Q96JB5
  ENSP ID: ENSP00000438886
MRRQSMTSATRDLHTALDGKATQGGKKDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGFVCESPTEQVLPMLRFVQKRGNSTVYEWRTGTEPSVVERPHLEELPEQVAEDAIDWGDFGVEAVSEGTDSGISAEAAGIDWGIFPESDSKDPGGDGIDWGDDAVALQITVLEAGTQAPEGVARGPDALTLLEYTETRNQFLDELMELEIFLAQRAVELSEEADVLSVSQFQLAPAILQGQTKEKMVTMVSVLEDLIGKLTSLQLQHLFMILASPRYVDRVTEFLQQKLKQSQLLALKKELMVQKQQEALEEQAALEPKLDLLLEKTKELQKLIEADISKRYSGRPVNLMGTSL

SEQ ID NO: 13495 - protein, 105 aa, Homo sapiens
  Payload ID: 2624
  Gene Symbol: CDK5RAP3
  Gene Name: CDK5 regulatory subunit associated protein 3
  ENSP ID: ENSP00000462012
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKARLAGDYSSV

SEQ ID NO: 13496 - protein, 118 aa, Homo sapiens
  Payload ID: 2624
  Gene Symbol: CDK5RAP3
  Gene Name: CDK5 regulatory subunit associated protein 3
  ENSP ID: ENSP00000462042
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLGGKINCF

SEQ ID NO: 13497 - protein, 124 aa, Homo sapiens
  Payload ID: 2624
  Gene Symbol: CDK5RAP3
  Gene Name: CDK5 regulatory subunit associated protein 3
  ENSP ID: ENSP00000462328
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLASWFGMSTMRSPH

SEQ ID NO: 13498 - protein, 48 aa, Homo sapiens
  Payload ID: 2624
  Gene Symbol: CDK5RAP3
  Gene Name: CDK5 regulatory subunit associated protein 3
  ENSP ID: ENSP00000462431
MEVWGQELGVLGTGRGPLTCVSGLPPEAAQPSPSLWPRSGPAGWWLGR

SEQ ID NO: 13499 - protein, 64 aa, Homo sapiens
  Payload ID: 2624
  Gene Symbol: CDK5RAP3
  Gene Name: CDK5 regulatory subunit associated protein 3
  ENSP ID: ENSP00000462886
MPESEEIAQLLSGSYIHYFHCLRILDLLKGTEASTKNIFGRYSSQRMKDWQEIIALYEKDNTYL

SEQ ID NO: 13500 - protein, 123 aa, Homo sapiens
  Payload ID: 2624
  Gene Symbol: CDK5RAP3
  Gene Name: CDK5 regulatory subunit associated protein 3
  ENSP ID: ENSP00000463431
MKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGFVC

SEQ ID NO: 13501 - protein, 103 aa, Homo sapiens
  Payload ID: 2624
  Gene Symbol: CDK5RAP3
  Gene Name: CDK5 regulatory subunit associated protein 3
  ENSP ID: ENSP00000463442
DHQHVPIDIQTSKLLDWLVDRRHCSLKWQSLVLTIREKINAAIQDMPESEEIAQLLSGSYIHYFHCLRILDLLKGTEASTKNIFGRYSSQRMKARLAGDYSSV

SEQ ID NO: 13502 - protein, 58 aa, Homo sapiens
  Payload ID: 2624
  Gene Symbol: CDK5RAP3
  Gene Name: CDK5 regulatory subunit associated protein 3
  ENSP ID: ENSP00000463878
MPESEEIAQLLSGSYIHYFHCLRILDLLKGTEASTKNIFGRYSSQRMKARLAGDYSSV

SEQ ID NO: 13503 - protein, 281 aa, Homo sapiens
  Payload ID: 2624
  Gene Symbol: CDK5RAP3
  Gene Name: CDK5 regulatory subunit associated protein 3
  ENSP ID: ENSP00000463950
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGPTEQVLPMLRFVQKRGNSTVYEWRTGTEPSVVERPHLEELPEQVAEDAIDWGDFGVEAVSEGTDSGIS

SEQ ID NO: 13504 - protein, 272 aa, Homo sapiens
  Payload ID: 2624
  Gene Symbol: CDK5RAP3
  Gene Name: CDK5 regulatory subunit associated protein 3
  ENSP ID: ENSP00000464286
  MOD_RES (1)..(1): Any amino acid
XDFGVEAVSEGTDSGISAEAAGIDWGIFPESDSKDPGGDGIDWGDDAVALQITVLEAGTQAPEGVARGPDALTLLEYTETRNQFLDELMELEIFLAQRAVELSEEADVLSVSQFQLAPAILQGQTKEKMVTMVSVLEDLIGKLTSLQLQHLFMILASPRYVDRVTEFLQQKLKQSQLLALKKELMVQKQQEALEEQAALEPKLDLLLEKTKELQKLIEADISKRQKTRLTGRWKATGRKRHLMVILALSMFSTRSCGDWPCGLSGENHRFSF

SEQ ID NO: 13505 - protein, 110 aa, Homo sapiens
  Payload ID: 2624
  Gene Symbol: CDK5RAP3
  Gene Name: CDK5 regulatory subunit associated protein 3
  ENSP ID: ENSP00000464419
MEVWGQELGPSARAHRHPDQQAARLAGGQKALQPEMAESGADDPREDQCCHPGHARERRDRPAAVWVLHSLLSLPKNPGPSQRHRGLHEEYFWPILFTADEGLAGDYSSV

SEQ ID NO: 13506 - protein, 196 aa, Homo sapiens
  Payload ID: 2624
  Gene Symbol: CDK5RAP3
  Gene Name: CDK5 regulatory subunit associated protein 3
  ENSP ID: ENSP00000464542
MRRQSMTSATRDLHTALDGKATQGGKKDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGIT

SEQ ID NO: 13507 - protein, 870 aa, Homo sapiens
  Payload ID: 2625
  Gene Symbol: CIZ1
  Gene Name: CDKN1A interacting zinc finger protein 1
  ENSP ID: ENSP00000277465
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13508 - protein, 252 aa, Homo sapiens
  Payload ID: 2625
  Gene Symbol: CIZ1
  Gene Name: CDKN1A interacting zinc finger protein 1
  ENSP ID: ENSP00000321780
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPC

SEQ ID NO: 13509 - protein, 870 aa, Homo sapiens; identical to SEQ ID NO: 13507
  Payload ID: 2625
  Gene Symbol: CIZ1
  Gene Name: CDKN1A interacting zinc finger protein 1
  ENSP ID: ENSP00000350169

SEQ ID NO: 13510 - protein, 898 aa, Homo sapiens
  Payload ID: 2625
  Gene Symbol: CIZ1
  Gene Name: CDKN1A interacting zinc finger protein 1
  Uniprot ID: Q9ULV3
  ENSP ID: ENSP00000362029
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13511 - protein, 842 aa, Homo sapiens
  Payload ID: 2625
  Gene Symbol: CIZ1
  Gene Name: CDKN1A interacting zinc finger protein 1
  Uniprot ID: Q9ULV3
  ENSP ID: ENSP00000362039
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13512 - protein, 818 aa, Homo sapiens
  Payload ID: 2625
  Gene Symbol: CIZ1
  Gene Name: CDKN1A interacting zinc finger protein 1
  Uniprot ID: Q9ULV3
  ENSP ID: ENSP00000362045
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13513 - protein, 837 aa, Homo sapiens
  Payload ID: 2625
  Gene Symbol: CIZ1
  Gene Name: CDKN1A interacting zinc finger protein 1
  ENSP ID: ENSP00000377232
MFSQQQQQQLQQQQQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13514 - protein, 820 aa, Homo sapiens
  Payload ID: 2625
  Gene Symbol: CIZ1
  Gene Name: CDKN1A interacting zinc finger protein 1
  ENSP ID: ENSP00000398011
PLPMAVSRGLPPQQPQQPLLNLQGTNSASLLNGSMLQRALLLQQLQGNLRGYGMASPGLAAPSLTPPQLATPNLQQFFPQATRQSLLGPPPVGVPMNPSQFNLSGRNPQKQARTSSSTTPNRKTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13515 - protein, 168 aa, Homo sapiens
  Payload ID: 2625
  Gene Symbol: CIZ1
  Gene Name: CDKN1A interacting zinc finger protein 1
  ENSP ID: ENSP00000407265
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVP

SEQ ID NO: 13516 - protein, 954 aa, Homo sapiens
  Payload ID: 2625
  Gene Symbol: CIZ1
  Gene Name: CDKN1A interacting zinc finger protein 1
  ENSP ID: ENSP00000439244
MYIRQLRAPSHRSPARGPRIAGPRRPQGATMFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKPPTPRRDVFAHVPVQGWSTARLVTDMIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13517 - protein, 797 aa, Homo sapiens
  Payload ID: 2625
  Gene Symbol: CIZ1
  Gene Name: CDKN1A interacting zinc finger protein 1
  Uniprot ID: Q9ULV3
  ENSP ID: ENSP00000486816
MPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 13518 - protein, 310 aa, Homo sapiens
  Payload ID: 2625
  Gene Symbol: CIZ1
  Gene Name: CDKN1A interacting zinc finger protein 1
  ENSP ID: ENSP00000489129
  MOD_RES (1)..(1): Any amino acid
XFFCYICKASCSSQQEFQDHMSEPQHQQRLGEIQHMSQACLLSLLPVPRDVLETEDEEPPPRRWCNTCQLYYMGDLIQHRRTQDHKPPTPRRDVFAHVPVQGWSTARLVTDMIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDK

SEQ ID NO: 13519 - protein, 898 aa, Homo sapiens; identical to SEQ ID NO: 13510
  Payload ID: 2625
  Gene Symbol: CIZ1
  Gene Name: CDKN1A interacting zinc finger protein 1
  ENSP ID: ENSP00000489425

SEQ ID NO: 13520 - protein, 126 aa, Homo sapiens
  Payload ID: 2626
  Gene Symbol: CDKN2AIP
  Gene Name: CDKN2A interacting protein
  ENSP ID: ENSP00000303788
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKKG

SEQ ID NO: 13521 - protein, 135 aa, Homo sapiens
  Payload ID: 2626
  Gene Symbol: CDKN2AIP
  Gene Name: CDKN2A interacting protein
  ENSP ID: ENSP00000421308
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKVKKRGISSSNG

SEQ ID NO: 13522 - protein, 580 aa, Homo sapiens
  Payload ID: 2626
  Gene Symbol: CDKN2AIP
  Gene Name: CDKN2A interacting protein
  Uniprot ID: Q9NXV6
  ENSP ID: ENSP00000427108
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKVKKRGISSSNEGVEEPSKKRVIEGKNSSAVEQDHAKTSAKTERASAQQENSSTCIGSAIKSESGNSARSSGISSQNSSTSDGDRSVSSQSSSSVSSQVTTAGSGKASEAEAPDKHGSASFVSLLKSSVNSHMTQSTDSRQQSGSPKKSALEGSSASASQSSSEIEVPLLGSSGSSEVELPLLSSKPSSETASSGLTSKTSSEASVSSSVAKNSSSSGTSLLTPKSSSSTNTSLLTSKSTSQVAASLLASKSSSQTSGSLVSKSTSLASVSQLASKSSSQTSTSQLPSKSTSQSSESSVKFSCKLTNEDVKQKQPFFNRLYKTVAWKLVAVGGFSPNVNHGELLNAAIEALKATLDVFFVPLKELADLPQNKSSQESIVCELRCKSVYLGTGCGKSKENAKAVASREALKLFLKKKVVVKICKRKYRGSEIEDLVLLDEESRPVNLPPALKHPQELL

SEQ ID NO: 13523 - protein, 85 aa, Homo sapiens
  Payload ID: 2627
  Gene Symbol: CDKN2AIPNL
  Gene Name: CDKN2A interacting protein N-terminal like
  Uniprot ID: Q96HQ2
  ENSP ID: ENSP00000378456
MVGGEAAAAVEELVSGVRQAADFAEQFRSYSESEKQWKARMEFILRHLPDYRDPPDGSGRLDQLLSLSMVWANHLFLGCSPRGPK

SEQ ID NO: 13524 - protein, 116 aa, Homo sapiens
  Payload ID: 2627
  Gene Symbol: CDKN2AIPNL
  Gene Name: CDKN2A interacting protein N-terminal like
  Uniprot ID: Q96HQ2
  ENSP ID: ENSP00000394183
MVGGEAAAAVEELVSGVRQAADFAEQFRSYSESEKQWKARMEFILRHLPDYRDPPDGSGRLDQLLSLSMVWANHLFLGCSYNKDLLDKVMEMADGIEVEDLPQFTTRSELMKKHQS

SEQ ID NO: 13525 - protein, 461 aa, Homo sapiens
  Payload ID: 2628
  Gene Symbol: CDS1
  Gene Name: CDP-diacylglycerol synthase (phosphatidate cytidylyltransferase) 1
  Uniprot ID: Q92903
  ENSP ID: ENSP00000295887
MLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 13526 - protein, 81 aa, Homo sapiens
  Payload ID: 2628
  Gene Symbol: CDS1
  Gene Name: CDP-diacylglycerol synthase (phosphatidate cytidylyltransferase) 1
  ENSP ID: ENSP00000421316
MLELRHRGSCPGPREAVSPPHREGEAAGGDHETESTSDKVEKLVDTWNSHSNYDLVVFPDHLYGILHADASCSGHPSEMLP

SEQ ID NO: 13527 - protein, 250 aa, Homo sapiens
  Payload ID: 2629
  Gene Symbol: CDS2
  Gene Name: CDP-diacylglycerol synthase (phosphatidate cytidylyltransferase) 2
  Uniprot ID: O95674
  ENSP ID: ENSP00000403205
MSRLRHPRTRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCE

SEQ ID NO: 13528 - protein, 445 aa, Homo sapiens
  Payload ID: 2629
  Gene Symbol: CDS2
  Gene Name: CDP-diacylglycerol synthase (phosphatidate cytidylyltransferase) 2
  Uniprot ID: O95674
  ENSP ID: ENSP00000419879
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 13529 - protein, 213 aa, Homo sapiens
  Payload ID: 2630
  Gene Symbol: CDIPT
  Gene Name: CDP-diacylglycerol--inositol 3-phosphatidyltransferase
  Uniprot ID: O14735
  ENSP ID: ENSP00000219789
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 13530 - protein, 213 aa, Homo sapiens; identical to SEQ ID NO: 13529
  Payload ID: 2630
  Gene Symbol: CDIPT
  Gene Name: CDP-diacylglycerol--inositol 3-phosphatidyltransferase
  Uniprot ID: O14735
  ENSP ID: ENSP00000454453

SEQ ID NO: 13531 - protein, 237 aa, Homo sapiens
  Payload ID: 2630
  Gene Symbol: CDIPT
  Gene Name: CDP-diacylglycerol--inositol 3-phosphatidyltransferase
  ENSP ID: ENSP00000455042
MSCRHSFPLLLPCSLHSHAFLSSCHGDLCPLTSHTACFLACVPPQAGGHFQSSFTPCVRVINQIWAPVLHPLCHNSPCPPNLPGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 13532 - protein, 41 aa, Homo sapiens
  Payload ID: 2630
  Gene Symbol: CDIPT
  Gene Name: CDP-diacylglycerol--inositol 3-phosphatidyltransferase
  ENSP ID: ENSP00000457207
MPDENIFLFVPNLIAACWTLSMDTLLALLIKEPGLGPCWTC

SEQ ID NO: 13533 - protein, 213 aa, Homo sapiens; identical to SEQ ID NO: 13529
  Payload ID: 2630
  Gene Symbol: CDIPT
  Gene Name: CDP-diacylglycerol--inositol 3-phosphatidyltransferase
  Uniprot ID: O14735
  ENSP ID: ENSP00000457339

SEQ ID NO: 13534 - protein, 168 aa, Homo sapiens
  Payload ID: 2630
  Gene Symbol: CDIPT
  Gene Name: CDP-diacylglycerol--inositol 3-phosphatidyltransferase
  Uniprot ID: O14735
  ENSP ID: ENSP00000457340
MPDENIFLFVPNLIGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 13535 - protein, 157 aa, Homo sapiens
  Payload ID: 2630
  Gene Symbol: CDIPT
  Gene Name: CDP-diacylglycerol--inositol 3-phosphatidyltransferase
  ENSP ID: ENSP00000457766
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRLALWDCSGWASGSLPPSPC

SEQ ID NO: 13536 - protein, 258 aa, Homo sapiens
  Payload ID: 2631
  Gene Symbol: CDV3
  Gene Name: CDV3 homolog (mouse)
  Uniprot ID: Q9UKY7
  ENSP ID: ENSP00000264993
MAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKDKEMEKSFEVVRHKNRGRDEVSKNQALKLQLDNQYAVLENQKSSHSQYN

SEQ ID NO: 13537 - protein, 213 aa, Homo sapiens
  Payload ID: 2631
  Gene Symbol: CDV3
  Gene Name: CDV3 homolog (mouse)
  Uniprot ID: Q9UKY7
  ENSP ID: ENSP00000391955
MAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRNRYLK

SEQ ID NO: 13538 - protein, 110 aa, Homo sapiens
  Payload ID: 2631
  Gene Symbol: CDV3
  Gene Name: CDV3 homolog (mouse)
  Uniprot ID: Q9UKY7
  ENSP ID: ENSP00000413272
MQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKYLK

SEQ ID NO: 13539 - protein, 188 aa, Homo sapiens
  Payload ID: 2631
  Gene Symbol: CDV3
  Gene Name: CDV3 homolog (mouse)
  ENSP ID: ENSP00000421340
  MOD_RES (1)..(1): Any amino acid
XLPRGTRRRRRSGATGRRVPRAQRAAPAEAVEPRDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKDKEMEKSFEVVRHKNRGRDEVSKNQ

SEQ ID NO: 13540 - protein, 108 aa, Homo sapiens
  Payload ID: 2631
  Gene Symbol: CDV3
  Gene Name: CDV3 homolog (mouse)
  ENSP ID: ENSP00000421495
MQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKY

SEQ ID NO: 13541 - protein, 156 aa, Homo sapiens
  Payload ID: 2631
  Gene Symbol: CDV3
  Gene Name: CDV3 homolog (mouse)
  ENSP ID: ENSP00000422866
MQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKDKEMEKSFEVVRHKNRGRDEVSKNQALKLQLDNQYAVLENQKSSHSQYN

SEQ ID NO: 13542 - protein, 53 aa, Homo sapiens
  Payload ID: 2631
  Gene Symbol: CDV3
  Gene Name: CDV3 homolog (mouse)
  ENSP ID: ENSP00000423349
MQISSEKEEDDNEKRQDPGDNWEEGGGGGGGMEKSSGPWNKTAPVQAPPAPVI

SEQ ID NO: 13543 - protein, 92 aa, Homo sapiens
  Payload ID: 2631
  Gene Symbol: CDV3
  Gene Name: CDV3 homolog (mouse)
  ENSP ID: ENSP00000424742
MQISEKEEDDNEKRQDPGDNWEEGGGGGGGMEKSSGPWNKTAPVQAPPAPVIVTETPEPAMTSGVYRPPGARLTTTRKTPQGPPEIYSDTQF

SEQ ID NO: 13544 - protein, 108 aa, Homo sapiens
  Payload ID: 2631
  Gene Symbol: CDV3
  Gene Name: CDV3 homolog (mouse)
  ENSP ID: ENSP00000425297
MQISSEKEEDDNEKRQDPGDNWEEGGGGGGGMEKSSGPWNKTAPVQAPPAPVIETPEPAMTSGVYRPPGARLTTTRKTPQGPPEIYSDTQFPSLQSTAKHVESRKYLK

SEQ ID NO: 13545 - protein, 80 aa, Homo sapiens
  Payload ID: 2632
  Gene Symbol: CEBPZOS
  Gene Name: CEBPZ opposite strand
  Uniprot ID: A8MTT3
  ENSP ID: ENSP00000380254
MARTLEPLAKKIFKGVLVAELVGVFGAYFLFSKMHTSQDFRQTMSKKYPFILEVYYKSTEKSGMYGIRELDQKTWLNSKN

SEQ ID NO: 13546 - protein, 80 aa, Homo sapiens; identical to SEQ ID NO: 13545
  Payload ID: 2632
  Gene Symbol: CEBPZOS
  Gene Name: CEBPZ opposite strand
  Uniprot ID: A8MTT3
  ENSP ID: ENSP00000380403

SEQ ID NO: 13547 - protein, 80 aa, Homo sapiens; identical to SEQ ID NO: 13545
  Payload ID: 2632
  Gene Symbol: CEBPZOS
  Gene Name: CEBPZ opposite strand
  Uniprot ID: A8MTT3
  ENSP ID: ENSP00000383895

SEQ ID NO: 13548 - protein, 80 aa, Homo sapiens; identical to SEQ ID NO: 13545
  Payload ID: 2632
  Gene Symbol: CEBPZOS
  Gene Name: CEBPZ opposite strand
  Uniprot ID: A8MTT3
  ENSP ID: ENSP00000384331

SEQ ID NO: 13549 - protein, 80 aa, Homo sapiens; identical to SEQ ID NO: 13545
  Payload ID: 2632
  Gene Symbol: CEBPZOS
  Gene Name: CEBPZ opposite strand
  Uniprot ID: A8MTT3
  ENSP ID: ENSP00000384813

SEQ ID NO: 13550 - protein, 1264 aa, Homo sapiens
  Payload ID: 2633
  Gene Symbol: CDON
  Gene Name: cell adhesion associated, oncogene regulated
  Uniprot ID: Q4KMG0
  ENSP ID: ENSP00000263577
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGDSCAHSETEINIVSWNALILPPVPEGCAEKTMWSPPGIPLDSPTEVLQQPRET

SEQ ID NO: 13551 - protein, 1287 aa, Homo sapiens
  Payload ID: 2633
  Gene Symbol: CDON
  Gene Name: cell adhesion associated, oncogene regulated
  Uniprot ID: Q4KMG0
  ENSP ID: ENSP00000376458
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGQEGMINLRIPDHLQLAKSCVWEGDSCAHSETEINIVSWNALILPPVPEGCAEKTMWSPPGIPLDSPTEVLQQPRET

SEQ ID NO: 13552 - protein, 243 aa, Homo sapiens
  Payload ID: 2633
  Gene Symbol: CDON
  Gene Name: cell adhesion associated, oncogene regulated
  ENSP ID: ENSP00000432571
  MOD_RES (1)..(1): Any amino acid
XNYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENGQEIYVGNV

SEQ ID NO: 13553 - protein, 641 aa, Homo sapiens
  Payload ID: 2633
  Gene Symbol: CDON
  Gene Name: cell adhesion associated, oncogene regulated
  ENSP ID: ENSP00000432901
MLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGDSCAHSETEINIVSWNALILPPVPEGCAEKTMWSPPGIPLDSPTEVLQQPRET

SEQ ID NO: 13554 - protein, 165 aa, Homo sapiens
  Payload ID: 2633
  Gene Symbol: CDON
  Gene Name: cell adhesion associated, oncogene regulated
  ENSP ID: ENSP00000434212
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHST

SEQ ID NO: 13555 - protein, 650 aa, Homo sapiens
  Payload ID: 2633
  Gene Symbol: CDON
  Gene Name: cell adhesion associated, oncogene regulated
  ENSP ID: ENSP00000436755
  MOD_RES (1)..(1): Any amino acid
XDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTS

SEQ ID NO: 13556 - protein, 142 aa, Homo sapiens
  Payload ID: 2633
  Gene Symbol: CDON
  Gene Name: cell adhesion associated, oncogene regulated
  ENSP ID: ENSP00000436940
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCR

SEQ ID NO: 13557 - protein, 111 aa, Homo sapiens
  Payload ID: 2633
  Gene Symbol: CDON
  Gene Name: cell adhesion associated, oncogene regulated
  ENSP ID: ENSP00000437176
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPA

SEQ ID NO: 13558 - protein, 471 aa, Homo sapiens
  Payload ID: 2634
  Gene Symbol: CADM1
  Gene Name: cell adhesion molecule 1
  Uniprot ID: Q9BY67
  ENSP ID: ENSP00000329797
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 13559 - protein, 442 aa, Homo sapiens
  Payload ID: 2634
  Gene Symbol: CADM1
  Gene Name: cell adhesion molecule 1
  Uniprot ID: Q9BY67
  ENSP ID: ENSP00000395359
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 13560 - protein, 414 aa, Homo sapiens
  Payload ID: 2634
  Gene Symbol: CADM1
  Gene Name: cell adhesion molecule 1
  Uniprot ID: Q9BY67
  ENSP ID: ENSP00000439176
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 13561 - protein, 182 aa, Homo sapiens
  Payload ID: 2634
  Gene Symbol: CADM1
  Gene Name: cell adhesion molecule 1
  ENSP ID: ENSP00000439696
MKASGHTSGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDG

SEQ ID NO: 13562 - protein, 453 aa, Homo sapiens
  Payload ID: 2634
  Gene Symbol: CADM1
  Gene Name: cell adhesion molecule 1
  Uniprot ID: Q9BY67
  ENSP ID: ENSP00000439817
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHDSRAGEEGSIRAVDHAVIGGVVAVVVFAMLCLLIILGRYFARHKGTYFTHEAKGADDAADADTAIINAEGGQNNSEEKKEYFI

SEQ ID NO: 13563 - protein, 79 aa, Homo sapiens
  Payload ID: 2634
  Gene Symbol: CADM1
  Gene Name: cell adhesion molecule 1
  ENSP ID: ENSP00000439847
MIDIQKDTAVEGEEIEVNCTAMASKPATTIRWFKGNTELKGKSEVEEWSDMYTVTSQLMLKVHKEDDGVPVICQVEHPA

SEQ ID NO: 13564 - protein, 443 aa, Homo sapiens
  Payload ID: 2634
  Gene Symbol: CADM1
  Gene Name: cell adhesion molecule 1
  ENSP ID: ENSP00000440322
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 13565 - protein, 110 aa, Homo sapiens
  Payload ID: 2634
  Gene Symbol: CADM1
  Gene Name: cell adhesion molecule 1
  ENSP ID: ENSP00000442001
MIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLT

SEQ ID NO: 13566 - protein, 188 aa, Homo sapiens
  Payload ID: 2634
  Gene Symbol: CADM1
  Gene Name: cell adhesion molecule 1
  ENSP ID: ENSP00000442227
  MOD_RES (1)..(1): Any amino acid
XSGDLPSYSPLPHSPRSQRSIPSVQGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQ

SEQ ID NO: 13567 - protein, 413 aa, Homo sapiens
  Payload ID: 2634
  Gene Symbol: CADM1
  Gene Name: cell adhesion molecule 1
  ENSP ID: ENSP00000442387
  MOD_RES (1)..(1): Any amino acid
XSVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 13568 - protein, 67 aa, Homo sapiens
  Payload ID: 2634
  Gene Symbol: CADM1
  Gene Name: cell adhesion molecule 1
  ENSP ID: ENSP00000445375
MASVVLPSGSQCAAAAAAAAPPGLRLRLLLLLFSAAALIPTGLTSSPRLECGGTISAHCSLGLPVLR

SEQ ID NO: 13569 - protein, 430 aa, Homo sapiens
  Payload ID: 2634
  Gene Symbol: CADM1
  Gene Name: cell adhesion molecule 1
  ENSP ID: ENSP00000482840
GDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHGLTQLPNSAEELDSEDLSDSRAGEEGSIRAVDHAVIGGVVAVVVFAMLCLLIILGRYFARHKGTYFTHEAKGADDAADADTAIINAEGGQNNSEEKKEYFI

SEQ ID NO: 13570 - protein, 401 aa, Homo sapiens
  Payload ID: 2634
  Gene Symbol: CADM1
  Gene Name: cell adhesion molecule 1
  ENSP ID: ENSP00000482924
GDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 13571 - protein, 346 aa, Homo sapiens
  Payload ID: 2634
  Gene Symbol: CADM1
  Gene Name: cell adhesion molecule 1
  ENSP ID: ENSP00000483648
GDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGLFSLTSSPRIK

SEQ ID NO: 13572 - protein, 373 aa, Homo sapiens
  Payload ID: 2634
  Gene Symbol: CADM1
  Gene Name: cell adhesion molecule 1
  ENSP ID: ENSP00000483793
GDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDSRAGEEGSIRAVDHAVIGGVVAVVVFAMLCLLIILGRYFARHKGTYFTHEAKGADDAADADTAIINAEGGQNNSEEKKEYFI

SEQ ID NO: 13573 - protein, 412 aa, Homo sapiens
  Payload ID: 2634
  Gene Symbol: CADM1
  Gene Name: cell adhesion molecule 1
  ENSP ID: ENSP00000484516
GDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDTTATTEPAVHDSRAGEEGSIRAVDHAVIGGVVAVVVFAMLCLLIILGRYFARHKGTYFTHEAKGADDAADADTAIINAEGGQNNSEEKKEYFI

SEQ ID NO: 13574 - protein, 404 aa, Homo sapiens
  Payload ID: 2635
  Gene Symbol: CADM2
  Gene Name: cell adhesion molecule 2
  Uniprot ID: Q8N3J6
  ENSP ID: ENSP00000373200
MIWKRSAVLRFYSVCGLLLQAAASKNKVKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDPNALAGQNGPDHALIGGIVAVVVFVTLCSIFLLGRYLARHKGTYLTNEAKGAEDAPDADTAIINAEGSQVNAEEKKEYFI

SEQ ID NO: 13575 - protein, 437 aa, Homo sapiens
  Payload ID: 2635
  Gene Symbol: CADM2
  Gene Name: cell adhesion molecule 2
  Uniprot ID: Q8N3J6
  ENSP ID: ENSP00000384193
MFVLFLCNLSLVPAAASKNKVKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDHALIGGIVAVVVFVTLCSIFLLGRYLARHKGTYLTNEAKGAEDAPDADTAIINAEGSQVNAEEKKEYFI

SEQ ID NO: 13576 - protein, 435 aa, Homo sapiens
  Payload ID: 2635
  Gene Symbol: CADM2
  Gene Name: cell adhesion molecule 2
  Uniprot ID: Q8N3J6
  ENSP ID: ENSP00000384575
MIWKRSAVLRFYSVCGLLLQGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDHALIGGIVAVVVFVTLCSIFLLGRYLARHKGTYLTNEAKGAEDAPDADTAIINAEGSQVNAEEKKEYFI

SEQ ID NO: 13577 - protein, 432 aa, Homo sapiens
  Payload ID: 2636
  Gene Symbol: CADM3
  Gene Name: cell adhesion molecule 3
  Uniprot ID: Q8N126
  ENSP ID: ENSP00000357106
MGAPAASLLLLLLLFACCWAPGGANLSQDGYWQEQDLELGTLAPLDEAISSTVWSSPDMLASQDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 13578 - protein, 398 aa, Homo sapiens
  Payload ID: 2636
  Gene Symbol: CADM3
  Gene Name: cell adhesion molecule 3
  Uniprot ID: Q8N126
  ENSP ID: ENSP00000357107
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 13579 - protein, 234 aa, Homo sapiens
  Payload ID: 2636
  Gene Symbol: CADM3
  Gene Name: cell adhesion molecule 3
  ENSP ID: ENSP00000387802
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNDTPTAMIRPDPPHPREGQKLLLHCEGRGNPVPQQYLWEKEGSVPPLKMTQ

SEQ ID NO: 13580 - protein, 388 aa, Homo sapiens
  Payload ID: 2637
  Gene Symbol: CADM4
  Gene Name: cell adhesion molecule 4
  Uniprot ID: Q8NFZ8
  ENSP ID: ENSP00000222374
MGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGSYLTHEASGLDEQGEAREAFLNGSDGHKRKEEFFI

SEQ ID NO: 13581 - protein, 1224 aa, Homo sapiens
  Payload ID: 2638
  Gene Symbol: CHL1
  Gene Name: cell adhesion molecule L1-like
  Uniprot ID: O00533
  ENSP ID: ENSP00000256509
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 13582 - protein, 1208 aa, Homo sapiens
  Payload ID: 2638
  Gene Symbol: CHL1
  Gene Name: cell adhesion molecule L1-like
  Uniprot ID: O00533
  ENSP ID: ENSP00000380628
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 13583 - protein, 84 aa, Homo sapiens
  Payload ID: 2638
  Gene Symbol: CHL1
  Gene Name: cell adhesion molecule L1-like
  ENSP ID: ENSP00000390440
MEPLLLGRGLIVYLMFLLLKFSKAIEIPSSVQQVPTIIKQSKVQVAFPFDEYFQIECEAKGNPEPTFSWTKDGNPFYFTDHRII

SEQ ID NO: 13584 - protein, 358 aa, Homo sapiens
  Payload ID: 2638
  Gene Symbol: CHL1
  Gene Name: cell adhesion molecule L1-like
  ENSP ID: ENSP00000395239
  MOD_RES (1)..(1): Any amino acid
XSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 13585 - protein, 181 aa, Homo sapiens
  Payload ID: 2638
  Gene Symbol: CHL1
  Gene Name: cell adhesion molecule L1-like
  ENSP ID: ENSP00000397445
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVY

SEQ ID NO: 13586 - protein, 65 aa, Homo sapiens
  Payload ID: 2638
  Gene Symbol: CHL1
  Gene Name: cell adhesion molecule L1-like
  ENSP ID: ENSP00000403311
MEPLLLGRGLIVYLMFLLLKFSKAIEIPSSVQQVPTIIKQSKVQVAFPFDEYFQIECEAKGNPEP

SEQ ID NO: 13587 - protein, 93 aa, Homo sapiens
  Payload ID: 2638
  Gene Symbol: CHL1
  Gene Name: cell adhesion molecule L1-like
  ENSP ID: ENSP00000413109
MPPAWSGESMDRGVVGLGSTKTQRGARAPPPQTAEGREGAPGAVVAMAPGSGARGAGDAGRGWSLLPLCASLFLSLFFFFWSVSVRGEAARRK

SEQ ID NO: 13588 - protein, 96 aa, Homo sapiens
  Payload ID: 2638
  Gene Symbol: CHL1
  Gene Name: cell adhesion molecule L1-like
  ENSP ID: ENSP00000413628
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPN

SEQ ID NO: 13589 - protein, 1171 aa, Homo sapiens
  Payload ID: 2638
  Gene Symbol: CHL1
  Gene Name: cell adhesion molecule L1-like
  ENSP ID: ENSP00000483512
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 13590 - protein, 923 aa, Homo sapiens
  Payload ID: 2639
  Gene Symbol: CCAR2
  Gene Name: cell cycle and apoptosis regulator 2
  Uniprot ID: Q8N163
  ENSP ID: ENSP00000310670
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 13591 - protein, 923 aa, Homo sapiens; identical to SEQ ID NO: 13590
  Payload ID: 2639
  Gene Symbol: CCAR2
  Gene Name: cell cycle and apoptosis regulator 2
  Uniprot ID: Q8N163
  ENSP ID: ENSP00000373930

SEQ ID NO: 13592 - protein, 615 aa, Homo sapiens
  Payload ID: 2639
  Gene Symbol: CCAR2
  Gene Name: cell cycle and apoptosis regulator 2
  ENSP ID: ENSP00000428549
  MOD_RES (1)..(1): Any amino acid
XVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 13593 - protein, 162 aa, Homo sapiens
  Payload ID: 2639
  Gene Symbol: CCAR2
  Gene Name: cell cycle and apoptosis regulator 2
  ENSP ID: ENSP00000428843
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQK

SEQ ID NO: 13594 - protein, 277 aa, Homo sapiens
  Payload ID: 2639
  Gene Symbol: CCAR2
  Gene Name: cell cycle and apoptosis regulator 2
  ENSP ID: ENSP00000429739
MWFLTVGDGSTSSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQG

SEQ ID NO: 13595 - protein, 81 aa, Homo sapiens
  Payload ID: 2639
  Gene Symbol: CCAR2
  Gene Name: cell cycle and apoptosis regulator 2
  ENSP ID: ENSP00000429769
MSQFKRQRINPLPGGRNFSGTASTSLLGPPPGLLTPPVATELSQNARHLQGGEKQRVFTGIVTSLHDYFGVVDEEVFFQLR

SEQ ID NO: 13596 - protein, 598 aa, Homo sapiens
  Payload ID: 2639
  Gene Symbol: CCAR2
  Gene Name: cell cycle and apoptosis regulator 2
  ENSP ID: ENSP00000429773
MLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKVRWGWTRRQHSSFP

SEQ ID NO: 13597 - protein, 183 aa, Homo sapiens
  Payload ID: 2639
  Gene Symbol: CCAR2
  Gene Name: cell cycle and apoptosis regulator 2
  ENSP ID: ENSP00000430974
  MOD_RES (1)..(1): Any amino acid
XLPVAAAAAAVVVPGVFVPPVSLPWPAGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHL

SEQ ID NO: 13598 - protein, 150 aa, Homo sapiens
  Payload ID: 2639
  Gene Symbol: CCAR2
  Gene Name: cell cycle and apoptosis regulator 2
  ENSP ID: ENSP00000430978
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIF

SEQ ID NO: 13599 - protein, 148 aa, Homo sapiens
  Payload ID: 2639
  Gene Symbol: CCAR2
  Gene Name: cell cycle and apoptosis regulator 2
  ENSP ID: ENSP00000431046
  MOD_RES (1)..(1): Any amino acid
XLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRR

SEQ ID NO: 13600 - protein, 272 aa, Homo sapiens [sequence omitted]

SEQ ID NO: 13601 - protein, 709 aa, Homo sapiens
  Payload ID: 2640
  Gene Symbol: CAPRIN1
  Gene Name: cell cycle associated protein 1
  Uniprot ID: Q14444
  ENSP ID: ENSP00000340329
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 13602 - protein, 694 aa, Homo sapiens
  Payload ID: 2640
  Gene Symbol: CAPRIN1
  Gene Name: cell cycle associated protein 1
  Uniprot ID: Q14444
  ENSP ID: ENSP00000374296
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGNILWW

SEQ ID NO: 13603 - protein, 186 aa, Homo sapiens
  Payload ID: 2640
  Gene Symbol: CAPRIN1
  Gene Name: cell cycle associated protein 1
  ENSP ID: ENSP00000431373
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLL

SEQ ID NO: 13604 - protein, 628 aa, Homo sapiens
  Payload ID: 2640
  Gene Symbol: CAPRIN1
  Gene Name: cell cycle associated protein 1
  ENSP ID: ENSP00000431581
MNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 13605 - protein, 709 aa, Homo sapiens; identical to SEQ ID NO: 13601
  Payload ID: 2640
  Gene Symbol: CAPRIN1
  Gene Name: cell cycle associated protein 1
  Uniprot ID: Q14444
  ENSP ID: ENSP00000434150

SEQ ID NO: 13606 - protein, 694 aa, Homo sapiens; identical to SEQ ID NO: 13602
  Payload ID: 2640
  Gene Symbol: CAPRIN1
  Gene Name: cell cycle associated protein 1
  Uniprot ID: Q14444
  ENSP ID: ENSP00000434204

SEQ ID NO: 13607 - protein, 649 aa, Homo sapiens
  Payload ID: 2640
  Gene Symbol: CAPRIN1
  Gene Name: cell cycle associated protein 1
  ENSP ID: ENSP00000483169
MKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPAMDSEEDMMVTALHSLTLQTVVIHSLSSVLPGITLAINGMDISRISSEALGRVDHGEPHEVVEGPQDPTEGCRK

SEQ ID NO: 13608 - protein, 149 aa, Homo sapiens [sequence omitted]

SEQ ID NO: 13609 - protein, 757 aa, Homo sapiens
  Payload ID: 2642
  Gene Symbol: CCPG1
  Gene Name: cell cycle progression 1
  Uniprot ID: Q9ULG6
  ENSP ID: ENSP00000311656
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 13610 - protein, 807 aa, Homo sapiens
  Payload ID: 2642
  Gene Symbol: CCPG1
  Gene Name: cell cycle progression 1
  Uniprot ID: Q9ULG6
  ENSP ID: ENSP00000403400
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPSRPDKKQRMVNIENSRHRKQEQKHLQPQPYKREGKWHKYGRTNGRQMANLEIELGQLPFDPQY

SEQ ID NO: 13611 - protein, 424 aa, Homo sapiens
  Payload ID: 2642
  Gene Symbol: CCPG1
  Gene Name: cell cycle progression 1
  Uniprot ID: Q9ULG6
  ENSP ID: ENSP00000415128
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRKLFTDFVNDVKDYLRNMKEYEVDNDGVFEKLDEYIYRHFFGHTFSPPYGPSRPDKKQRMVNIENSRHRKQEQKHLQPQPYKREGKWHKYGRTNGRQMANLEIELGQLPFDPQY

SEQ ID NO: 13612 - protein, 757 aa, Homo sapiens; identical to SEQ ID NO: 13609
  Payload ID: 2642
  Gene Symbol: CCPG1
  Gene Name: cell cycle progression 1
  Uniprot ID: Q9ULG6
  ENSP ID: ENSP00000454456

SEQ ID NO: 13613 - protein, 203 aa, Homo sapiens
  Payload ID: 2642
  Gene Symbol: CCPG1
  Gene Name: cell cycle progression 1
  ENSP ID: ENSP00000454666
  MOD_RES (1)..(1): Any amino acid
XKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQSRPDKKQRMVNIENSRHRKQEQKHLQPQPYKREGKWHKYGRTNGRQMANLEIELGQLPFDPQY

SEQ ID NO: 13614 - protein, 240 aa, Homo sapiens
  Payload ID: 2642
  Gene Symbol: CCPG1
  Gene Name: cell cycle progression 1
  ENSP ID: ENSP00000454802
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETERWWEKLWKIPECIWGWDDQLKHHVPSQLAFQVFSSQPSDDESSSDETSNQPSPAFRRRRARKKTVSASESEDRLVAEQETEPSKELSK

SEQ ID NO: 13615 - protein, 32 aa, Homo sapiens
  Payload ID: 2642
  Gene Symbol: CCPG1
  Gene Name: cell cycle progression 1
  ENSP ID: ENSP00000455406
  MOD_RES (1)..(1): Any amino acid
XRKIHEDELNDMKDYLSQCQQEQESFIDYKST

SEQ ID NO: 13616 - protein, 152 aa, Homo sapiens
  Payload ID: 2642
  Gene Symbol: CCPG1
  Gene Name: cell cycle progression 1
  ENSP ID: ENSP00000455852
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETA

SEQ ID NO: 13617 - protein, 92 aa, Homo sapiens
  Payload ID: 2642
  Gene Symbol: CCPG1
  Gene Name: cell cycle progression 1
  ENSP ID: ENSP00000456045
MSENSSDSDSSCGWTVISHEGSDIEMLNSVTPTDSCEPAPECSSLEQEELQALQIEQGESSQNGTVLMEETAYPALEETSSTIEAEEQKIPE

SEQ ID NO: 13618 - protein, 170 aa, Homo sapiens
  Payload ID: 2642
  Gene Symbol: CCPG1
  Gene Name: cell cycle progression 1
  ENSP ID: ENSP00000457393
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQ

SEQ ID NO: 13619 - protein, 117 aa, Homo sapiens
  Payload ID: 2642
  Gene Symbol: CCPG1
  Gene Name: cell cycle progression 1
  ENSP ID: ENSP00000457967
  MOD_RES (1)..(1): Any amino acid
XTDFVNDVKDYLRNMKEYEVDNDGVFEKLDEYIYRHFFGHTFSPPYGPSRPDKKQRMVNIENSRHRKQEQKHLQPQPYKREDGVLLCRPGWSAVARSRLTASSASRVHAILLPQPPE

SEQ ID NO: 13620 - protein, 219 aa, Homo sapiens
  Payload ID: 2643
  Gene Symbol: CIDEA
  Gene Name: cell death-inducing DFFA-like effector a
  Uniprot ID: O60543
  ENSP ID: ENSP00000320209
MEAARDYAGALIRPLTFMGSQTKRVLFTPLMHPARPFRVSNHDRSSRRGVMASSLQELISKTLDALVIATGLVTLVLEEDGTVVDTEEFFQTLGDNTHFMILEKGQKWMPGSQHVPTCSPPKRSGIARVTFDLYRLNPKDFIGCLNVKATMYEMYSVSYDIRCTGLKGLLRSLLRFLSYSAQVTGQFLIYLGTYMLRVLDDKEERPSLRSQAKGRFTCG

SEQ ID NO: 13621 - protein, 200 aa, Homo sapiens
  Payload ID: 2643
  Gene Symbol: CIDEA
  Gene Name: cell death-inducing DFFA-like effector a
  ENSP ID: ENSP00000429238
MEAARDYAGALIRRVPRVPLIAVRFQSPCVRWPHIPLCASSTVPRSLQPPAPRILLRSATPRTHPSAPLVPKPSSRARGQSPIPSRASSPSCSWAQVPGVALARCAGVCKPGDSWRVAACISGRCCSRGRRRGSGPRNPEQSFRDARGPGFWGSWKSQRELGAGGAQAWPLLEARALVSEGRPQPSGGALQAPDIYGITD

SEQ ID NO: 13622 - protein, 219 aa, Homo sapiens
  Payload ID: 2644
  Gene Symbol: CIDEB
  Gene Name: cell death-inducing DFFA-like effector b
  Uniprot ID: Q9UHD4
  ENSP ID: ENSP00000258807
MEYLSALNPSDLLRSVSNISSEFGRRVWTSAPPPQRPFRVCDHKRTIRKGLTAATRQELLAKALETLLLNGVLTLVLEEDGTAVDSEDFFQLLEDDTCLMVLQSGQSWSPTRSGVLSYGLGRERPKHSKDIARFTFDVYKQNPRDLFGSLNVKATFYGLYSMSCDFQGLGPKKVLRELLRWTSTLLQGLGHMLLGISSTLRHAVEGAEQWQQKGRLHSY

SEQ ID NO: 13623 - protein, 219 aa, Homo sapiens; identical to SEQ ID NO: 13622
  Payload ID: 2644
  Gene Symbol: CIDEB
  Gene Name: cell death-inducing DFFA-like effector b
  Uniprot ID: Q9UHD4
  ENSP ID: ENSP00000337731

SEQ ID NO: 13624 - protein, 219 aa, Homo sapiens; identical to SEQ ID NO: 13622
  Payload ID: 2644
  Gene Symbol: CIDEB
  Gene Name: cell death-inducing DFFA-like effector b
  Uniprot ID: Q9UHD4
  ENSP ID: ENSP00000451089

SEQ ID NO: 13625 - protein, 61 aa, Homo sapiens
  Payload ID: 2644
  Gene Symbol: CIDEB
  Gene Name: cell death-inducing DFFA-like effector b
  ENSP ID: ENSP00000451744
  MOD_RES (1)..(1): Any amino acid
XVDSEDFFQLLEDDTCLMVLQSGQSWSPTRGAPSLDLHTAARPGPYVAGNFLHPSSCSGGG

SEQ ID NO: 13626 - protein, 238 aa, Homo sapiens
  Payload ID: 2645
  Gene Symbol: CIDEC
  Gene Name: cell death-inducing DFFA-like effector c
  Uniprot ID: Q96AQ7
  ENSP ID: ENSP00000338642
MEYAMKSLSLLYPKSLSRHVSVRTSVVTQQLLSEPSPKAPRARPCRVSTADRSVRKGIMAYSLEDLLLKVRDTLMLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 13627 - protein, 251 aa, Homo sapiens
  Payload ID: 2645
  Gene Symbol: CIDEC
  Gene Name: cell death-inducing DFFA-like effector c
  ENSP ID: ENSP00000373328
MRNMESNAVQLTRMEYAMKSLSLLYPKSLSRHVSVRTSVVTQQLLSEPSPKAPRARPCRVSTADRSVRKGIMAYSLEDLLLKVRDTLMLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 13628 - protein, 164 aa, Homo sapiens
  Payload ID: 2645
  Gene Symbol: CIDEC
  Gene Name: cell death-inducing DFFA-like effector c
  Uniprot ID: Q96AQ7
  ENSP ID: ENSP00000392975
MLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 13629 - protein, 164 aa, Homo sapiens; identical to SEQ ID NO: 13628
  Payload ID: 2645
  Gene Symbol: CIDEC
  Gene Name: cell death-inducing DFFA-like effector c
  Uniprot ID: Q96AQ7
  ENSP ID: ENSP00000400649

SEQ ID NO: 13630 - protein, 248 aa, Homo sapiens
  Payload ID: 2645
  Gene Symbol: CIDEC
  Gene Name: cell death-inducing DFFA-like effector c
  Uniprot ID: Q96AQ7
  ENSP ID: ENSP00000408631
MEYAMKSLSLLYPKSLSRHVSVRTSVVTQQLLSEPSPKAPRARPCRVSTADRSVRKGIMAYSLEDLLLKTRNPEARSQEVRDTLMLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 13631 - protein, 133 aa, Homo sapiens
  Payload ID: 2645
  Gene Symbol: CIDEC
  Gene Name: cell death-inducing DFFA-like effector c
  ENSP ID: ENSP00000411356
MEYAMKSLSLLYPKSLSRHVSVRTSVVTQQLLSEPSPKAPRARPCRVSTADRSVRKGIMAYSLEDLLLKGSFPLGPLQHAGHRPRTAWHLLLPAAAPRCYGGRAAPQGQGLIPYPDLSEDTAVKAQVLGSFPQ

SEQ ID NO: 13632 - protein, 248 aa, Homo sapiens; identical to SEQ ID NO: 13630
  Payload ID: 2645
  Gene Symbol: CIDEC
  Gene Name: cell death-inducing DFFA-like effector c
  Uniprot ID: Q96AQ7
  ENSP ID: ENSP00000483641

SEQ ID NO: 13633 - protein, 208 aa, Homo sapiens
  Payload ID: 2646
  Gene Symbol: CDIP1
  Gene Name: cell death-inducing p53 target 1
  Uniprot ID: Q9H305
  ENSP ID: ENSP00000382508
MSSEPPPPYPGGPTAPLLEEKSGAPPTPGRSSPAVMQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 13634 - protein, 208 aa, Homo sapiens; identical to SEQ ID NO: 13633
  Payload ID: 2646
  Gene Symbol: CDIP1
  Gene Name: cell death-inducing p53 target 1
  Uniprot ID: Q9H305
  ENSP ID: ENSP00000454994

SEQ ID NO: 13635 - protein, 129 aa, Homo sapiens
  Payload ID: 2646
  Gene Symbol: CDIP1
  Gene Name: cell death-inducing p53 target 1
  Uniprot ID: Q9H305
  ENSP ID: ENSP00000455050
MSSEPPPPYPGGPTAPLLEEKSGAPPTPGRSSPAVMQPPPGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 13636 - protein, 169 aa, Homo sapiens
  Payload ID: 2646
  Gene Symbol: CDIP1
  Gene Name: cell death-inducing p53 target 1
  Uniprot ID: Q9H305
  ENSP ID: ENSP00000455462
MSSEPPPPYPGGPTAPLLEEKSGAPPTPGRSSPAVMQPPPGMPLPPADIGPPPYEPPGHPMPQPGFIPPHMSADGTYMPPGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 13637 - protein, 52 aa, Homo sapiens
  Payload ID: 2646
  Gene Symbol: CDIP1
  Gene Name: cell death-inducing p53 target 1
  ENSP ID: ENSP00000456461
MQPPPGMPLPPADIGPPPYEPPGHPMPQPGFIPPHMSADGTYMPPDVIWAAA

SEQ ID NO: 13638 - protein, 133 aa, Homo sapiens
  Payload ID: 2646
  Gene Symbol: CDIP1
  Gene Name: cell death-inducing p53 target 1
  ENSP ID: ENSP00000457255
MSSEPPPPYPGGPTAPLLEEKSGAPPTPGRSSPAVMQPPPGMPLPPADIGPPPYEPPGHPMPQPGFIPPHMSADGTYMPPAAKPTSTRTSACANGAGTRDSPACQSGPLCFAPCAQWSLSRSHLGLGAVPPSP

SEQ ID NO: 13639 - protein, 111 aa, Homo sapiens
  Payload ID: 2646
  Gene Symbol: CDIP1
  Gene Name: cell death-inducing p53 target 1
  ENSP ID: ENSP00000457370
MQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQ

SEQ ID NO: 13640 - protein, 208 aa, Homo sapiens; identical to SEQ ID NO: 13633
  Payload ID: 2646
  Gene Symbol: CDIP1
  Gene Name: cell death-inducing p53 target 1
  Uniprot ID: Q9H305
  ENSP ID: ENSP00000457877

SEQ ID NO: 13641 - protein, 95 aa, Homo sapiens
  Payload ID: 2646
  Gene Symbol: CDIP1
  Gene Name: cell death-inducing p53 target 1
  ENSP ID: ENSP00000465412
MQPPPGMPLPPADIGPPPYEPPGHPMPQPGFIPPHMSADGTYMPPGFYPPPGPHPPMGYYPPGPYTPGPYPGPGGHTATVLVPSGAATTVTVLQG

SEQ ID NO: 13642 - protein, 152 aa, Homo sapiens
  Payload ID: 2646
  Gene Symbol: CDIP1
  Gene Name: cell death-inducing p53 target 1
  ENSP ID: ENSP00000466186
MSSEPPPPYPGGPTAPLLEEKSGAPPTPGRSSPAVMQPPPGMPLPPADIGPPPYEPPGHPMPQPGFIPPHMSADGTYMPPGPYTPGPYPGPGGHTATVLVPSGAATTVTVLQGEIFEGAPVQTVCPHCQQAITTKISYEIGLMNFVLGFFCC

SEQ ID NO: 13643 - protein, 89 aa, Homo sapiens
  Payload ID: 2646
  Gene Symbol: CDIP1
  Gene Name: cell death-inducing p53 target 1
  ENSP ID: ENSP00000466378
MQPPPGMPLPPADIGPPPYEPPGHPMPQPGFIPPHMSADGTYMPPGPYPGPGGHTATVLVPSGAATTVTVLQGEIFEGAPVQTVCPHCQ

SEQ ID NO: 13644 - protein, 28 aa, Homo sapiens
  Payload ID: 2646
  Gene Symbol: CDIP1
  Gene Name: cell death-inducing p53 target 1
  ENSP ID: ENSP00000467058
MSSEPPPPYPGGPTAPLLEEKSGAPPTP

SEQ ID NO: 13645 - protein, 81 aa, Homo sapiens
  Payload ID: 2646
  Gene Symbol: CDIP1
  Gene Name: cell death-inducing p53 target 1
  ENSP ID: ENSP00000468627
MSSEPPPPYPGGPTAPLLEEKSGAPPTPGRSSPAVMQPPPGMPLPPADIGPPPYEPPGHPMPQPGFIPPHMSADGTYMPPG

SEQ ID NO: 13646 - protein, 208 aa, Homo sapiens; identical to SEQ ID NO: 13633
  Payload ID: 2646
  Gene Symbol: CDIP1
  Gene Name: cell death-inducing p53 target 1
  Uniprot ID: Q9H305
  ENSP ID: ENSP00000480842

SEQ ID NO: 13647 - protein, 89 aa, Homo sapiens; identical to SEQ ID NO: 13643
  Payload ID: 2646
  Gene Symbol: CDIP1
  Gene Name: cell death-inducing p53 target 1
  ENSP ID: ENSP00000487615

SEQ ID NO: 13648 - protein, 169 aa, Homo sapiens; identical to SEQ ID NO: 13636
  Payload ID: 2646
  Gene Symbol: CDIP1
  Gene Name: cell death-inducing p53 target 1
  Uniprot ID: Q9H305
  ENSP ID: ENSP00000487657

SEQ ID NO: 13649 - protein, 133 aa, Homo sapiens; identical to SEQ ID NO: 13638
  Payload ID: 2646
  Gene Symbol: CDIP1
  Gene Name: cell death-inducing p53 target 1
  ENSP ID: ENSP00000487791

SEQ ID NO: 13650 - protein, 208 aa, Homo sapiens; identical to SEQ ID NO: 13633
  Payload ID: 2646
  Gene Symbol: CDIP1
  Gene Name: cell death-inducing p53 target 1
  Uniprot ID: Q9H305
  ENSP ID: ENSP00000488066

SEQ ID NO: 13651 - protein, 81 aa, Homo sapiens; identical to SEQ ID NO: 13645
  Payload ID: 2646
  Gene Symbol: CDIP1
  Gene Name: cell death-inducing p53 target 1
  ENSP ID: ENSP00000488219

SEQ ID NO: 13652 - protein, 28 aa, Homo sapiens
  Payload ID: 2646
  Gene Symbol: CDIP1
  Gene Name: cell death-inducing p53 target 1
  ENSP ID: ENSP00000488234
MSSEPPPPYPGGPTAPLLEEKSGAPPTP

SEQ ID NO: 13653 - protein, 111 aa, Homo sapiens; identical to SEQ ID NO: 13639
  Payload ID: 2646
  Gene Symbol: CDIP1
  Gene Name: cell death-inducing p53 target 1
  ENSP ID: ENSP00000488327

SEQ ID NO: 13654 - protein, 152 aa, Homo sapiens; identical to SEQ ID NO: 13642
  Payload ID: 2646
  Gene Symbol: CDIP1
  Gene Name: cell death-inducing p53 target 1
  ENSP ID: ENSP00000488447

SEQ ID NO: 13655 - protein, 208 aa, Homo sapiens; identical to SEQ ID NO: 13633
  Payload ID: 2646
  Gene Symbol: CDIP1
  Gene Name: cell death-inducing p53 target 1
  Uniprot ID: Q9H305
  ENSP ID: ENSP00000488474

SEQ ID NO: 13656 - protein, 52 aa, Homo sapiens; identical to SEQ ID NO: 13637
  Payload ID: 2646
  Gene Symbol: CDIP1
  Gene Name: cell death-inducing p53 target 1
  ENSP ID: ENSP00000488525

SEQ ID NO: 13657 - protein, 95 aa, Homo sapiens; identical to SEQ ID NO: 13641
  Payload ID: 2646
  Gene Symbol: CDIP1
  Gene Name: cell death-inducing p53 target 1
  ENSP ID: ENSP00000488573

SEQ ID NO: 13658 - protein, 129 aa, Homo sapiens; identical to SEQ ID NO: 13635
  Payload ID: 2646
  Gene Symbol: CDIP1
  Gene Name: cell death-inducing p53 target 1
  Uniprot ID: Q9H305
  ENSP ID: ENSP00000488843

SEQ ID NO: 13659 - protein, 336 aa, Homo sapiens
  Payload ID: 2647
  Gene Symbol: CDC123
  Gene Name: cell division cycle 123
  Uniprot ID: O75794
  ENSP ID: ENSP00000281141
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 13660 - protein, 295 aa, Homo sapiens
  Payload ID: 2647
  Gene Symbol: CDC123
  Gene Name: cell division cycle 123
  ENSP ID: ENSP00000368178
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIVVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 13661 - protein, 144 aa, Homo sapiens
  Payload ID: 2647
  Gene Symbol: CDC123
  Gene Name: cell division cycle 123
  ENSP ID: ENSP00000391851
  MOD_RES (1)..(1): Any amino acid
XFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQKRNQQEDD

SEQ ID NO: 13662 - protein, 183 aa, Homo sapiens
  Payload ID: 2647
  Gene Symbol: CDC123
  Gene Name: cell division cycle 123
  ENSP ID: ENSP00000398724
MKKEHVLHCQFSAWYPFFRGVTIKSVILPLPQNVKDYLLDDGTLVVSGRDDPPTHSQPDSDDEAEEIQWSDDENTATLTDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQD

SEQ ID NO: 13663 - protein, 157 aa, Homo sapiens
  Payload ID: 2647
  Gene Symbol: CDC123
  Gene Name: cell division cycle 123
  ENSP ID: ENSP00000415806
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPD

SEQ ID NO: 13664 - protein, 594 aa, Homo sapiens
  Payload ID: 2648
  Gene Symbol: CDC14A
  Gene Name: cell division cycle 14A
  Uniprot ID: Q9UNH5
  ENSP ID: ENSP00000336739
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPSLQSEYVHY

SEQ ID NO: 13665 - protein, 623 aa, Homo sapiens
  Payload ID: 2648
  Gene Symbol: CDC14A
  Gene Name: cell division cycle 14A
  Uniprot ID: Q9UNH5
  ENSP ID: ENSP00000354916
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPVSAQTPPPGPQNPECNFCALPSQPRLPPKKFNSAKEAF

SEQ ID NO: 13666 - protein, 383 aa, Homo sapiens
  Payload ID: 2648
  Gene Symbol: CDC14A
  Gene Name: cell division cycle 14A
  Uniprot ID: Q9UNH5
  ENSP ID: ENSP00000359142
MAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEVSFP

SEQ ID NO: 13667 - protein, 272 aa, Homo sapiens
  Payload ID: 2648
  Gene Symbol: CDC14A
  Gene Name: cell division cycle 14A
  ENSP ID: ENSP00000388501
MGNFLSRENKVQVISESDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTE

SEQ ID NO: 13668 - protein, 565 aa, Homo sapiens
  Payload ID: 2648
  Gene Symbol: CDC14A
  Gene Name: cell division cycle 14A
  ENSP ID: ENSP00000489217
MVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPVSAQTPPPGPQNPECNFCALPSQPRLPPKKFNSAKEAF

SEQ ID NO: 13669 - protein, 459 aa, Homo sapiens
  Payload ID: 2649
  Gene Symbol: CDC14B
  Gene Name: cell division cycle 14B
  Uniprot ID: O60729
  ENSP ID: ENSP00000364388
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTLSISRTKTVLR

SEQ ID NO: 13670 - protein, 498 aa, Homo sapiens
  Payload ID: 2649
  Gene Symbol: CDC14B
  Gene Name: cell division cycle 14B
  Uniprot ID: O60729
  ENSP ID: ENSP00000364389
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 13671 - protein, 461 aa, Homo sapiens
  Payload ID: 2649
  Gene Symbol: CDC14B
  Gene Name: cell division cycle 14B
  Uniprot ID: O60729
  ENSP ID: ENSP00000364390
MSREGAGAALVAEVIKDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 13672 - protein, 268 aa, Homo sapiens
  Payload ID: 2649
  Gene Symbol: CDC14B
  Gene Name: cell division cycle 14B
  ENSP ID: ENSP00000396951
  MOD_RES (1)..(1): Any amino acid
XMLWSHEPGGRGGSFGSRGDQRKEHCNFSISDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGST

SEQ ID NO: 13673 - protein, 228 aa, Homo sapiens
  Payload ID: 2649
  Gene Symbol: CDC14B
  Gene Name: cell division cycle 14B
  ENSP ID: ENSP00000400480
APRRGLEKEGVTLVAFEPAGKTNVRVVTFEKSQPARADRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHS

SEQ ID NO: 13674 - protein, 480 aa, Homo sapiens
  Payload ID: 2649
  Gene Symbol: CDC14B
  Gene Name: cell division cycle 14B
  ENSP ID: ENSP00000413940
ERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 13675 - protein, 471 aa, Homo sapiens
  Payload ID: 2649
  Gene Symbol: CDC14B
  Gene Name: cell division cycle 14B
  Uniprot ID: O60729
  ENSP ID: ENSP00000417897
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTDGWLSQAVTFLDRLLIWLGIHKD

SEQ ID NO: 13676 - protein, 485 aa, Homo sapiens
  Payload ID: 2649
  Gene Symbol: CDC14B
  Gene Name: cell division cycle 14B
  Uniprot ID: O60729
  ENSP ID: ENSP00000420572
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 13677 - protein, 619 aa, Homo sapiens
  Payload ID: 2650
  Gene Symbol: CDC16
  Gene Name: cell division cycle 16
  Uniprot ID: Q13042
  ENSP ID: ENSP00000252457
MNLERLRKRVRQYLDQQQYQSALFWADKVASLSREPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 13678 - protein, 475 aa, Homo sapiens
  Payload ID: 2650
  Gene Symbol: CDC16
  Gene Name: cell division cycle 16
  ENSP ID: ENSP00000252458
MEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 13679 - protein, 620 aa, Homo sapiens
  Payload ID: 2650
  Gene Symbol: CDC16
  Gene Name: cell division cycle 16
  Uniprot ID: Q13042
  ENSP ID: ENSP00000348554
MNLERLRKRVRQYLDQQQYQSALFWADKVASLSREEPQDIYWLAQCLYLTAQYHRAAHALRSRKLDKLYEACRYLAARCHYAAKEHQQALDVLDMEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 13680 - protein, 620 aa, Homo sapiens; identical to SEQ ID NO: 13679
  Payload ID: 2650
  Gene Symbol: CDC16
  Gene Name: cell division cycle 16
  Uniprot ID: Q13042
  ENSP ID: ENSP00000353549

SEQ ID NO: 13681 - protein, 526 aa, Homo sapiens
  Payload ID: 2650
  Gene Symbol: CDC16
  Gene Name: cell division cycle 16
  Uniprot ID: Q13042
  ENSP ID: ENSP00000364457
MEEPINKRLFEKYLKDESGFKDPSSDWEMSQSSIKSSICLLRGKIYDALDNRTLATYSYKEALKLDVYCFEAFDLLTSHHMLTAQEEKELLESLPLSKLCNEEQELLRFLFENKLKKYNKPSETVIPESVDGLQENLDVVVSLAERHYYNCDFKMCYKLTSVVMEKDPFHASCLPVHIGTLVELNKANELFYLSHKLVDLYPSNPVSWFAVGCYYLMVGHKNEHARRYLSKATTLEKTYGPAWIAYGHSFAVESEHDQAMAAYFTAAQLMKGCHLPMLYIGLEYGLTNNSKLAERFFSQALSIAPEDPFVMHEVGVVAFQNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 13682 - protein, 526 aa, Homo sapiens; identical to SEQ ID NO: 13681
  Payload ID: 2650
  Gene Symbol: CDC16
  Gene Name: cell division cycle 16
  Uniprot ID: Q13042
  ENSP ID: ENSP00000364459

SEQ ID NO: 13683 - protein, 475 aa, Homo sapiens; identical to SEQ ID NO: 13678
  Payload ID: 2650
  Gene Symbol: CDC16
  Gene Name: cell division cycle 16
  ENSP ID: ENSP00000486027

SEQ ID NO: 13684 - protein, 499 aa, Homo sapiens
  Payload ID: 2651
  Gene Symbol: CDC20
  Gene Name: cell division cycle 20
  Uniprot ID: Q12834
  ENSP ID: ENSP00000308450
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 13685 - protein, 499 aa, Homo sapiens; identical to SEQ ID NO: 13684
  Payload ID: 2651
  Gene Symbol: CDC20
  Gene Name: cell division cycle 20
  Uniprot ID: Q12834
  ENSP ID: ENSP00000361540

SEQ ID NO: 13686 - protein, 515 aa, Homo sapiens
  Payload ID: 2652
  Gene Symbol: CDC20B
  Gene Name: cell division cycle 20B
  Uniprot ID: Q86Y33
  ENSP ID: ENSP00000296733
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKAMDWCPWQSGVLAIGGGMKDGRLHILDINAGKSIQTPSTNSQICSLIWLPKTKEIATGQGTPKNDVTVWTCPTVSRSGHRGRVLHLSLSPDQTRVFSAAADGTASVWNCY

SEQ ID NO: 13687 - protein, 477 aa, Homo sapiens
  Payload ID: 2652
  Gene Symbol: CDC20B
  Gene Name: cell division cycle 20B
  Uniprot ID: Q86Y33
  ENSP ID: ENSP00000315720
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKICSLIWLPKTKEIATGQGTPKNDVTVWTCPTVSRSGGFFGHRGRVLHLSLSPDQTRVFSAAADGTASVWNCY

SEQ ID NO: 13688 - protein, 519 aa, Homo sapiens
  Payload ID: 2652
  Gene Symbol: CDC20B
  Gene Name: cell division cycle 20B
  Uniprot ID: Q86Y33
  ENSP ID: ENSP00000370781
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSSGSRLGRVYHHDVRVAQHHVGTLRHKQAVCALKWSPDGRLLSSGCSDGLLTIWPHDPGASAQGQPLKVITQSTAVKAMDWCPWQSGVLAIGGGMKDGRLHILDINAGKSIQTPSTNSQICSLIWLPKTKEIATGQGTPKNDVTVWTCPTVSRSGGFFGHRGRVLHLSLSPDQTRVFSAAADGTASVWNCY

SEQ ID NO: 13689 - protein, 192 aa, Homo sapiens
  Payload ID: 2652
  Gene Symbol: CDC20B
  Gene Name: cell division cycle 20B
  Uniprot ID: Q86Y33
  ENSP ID: ENSP00000423919
MEWKLERTAPRRVRTEEEMLWVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKDHFSGSMKKRFEQEDVGGKD

SEQ ID NO: 13690 - protein, 372 aa, Homo sapiens
  Payload ID: 2652
  Gene Symbol: CDC20B
  Gene Name: cell division cycle 20B
  Uniprot ID: Q86Y33
  ENSP ID: ENSP00000426776
MEWKLERTAPRRVRTEEEMLWESIMRVLSKDLKQKRSQDSANVLDSVNATYSDFKSNFAKRLSAEVPVASSPITTRWQQSQTRALSSDSFGEEQSTTYLPEASGSVLKTPPEKETLTLGSRKEQLKTPSKGISETSNSALHFCKAPHAMDRDWKESVASKGQKCLKQLFVTQNVVQQANGKMQLCEQSECVWKGCKDGVRDESFHLKSSGDINDSILQPEVKIHITGLRNDYYLNILDWSFQNLVAIALGSAVYIWNGENHNGIENIDLSLTCNYISSVSWIKEGTCLAVGTSEGEVQLWDVVTKKRLRNMLGHLSVVGALSWNHFILSRLEFSGVISAHCNLHLPSSWDYRRPPPCLVGQDWGVFIITMFG

SEQ ID NO: 13691 - protein, 151 aa, Homo sapiens
  Payload ID: 2653
  Gene Symbol: CDC23
  Gene Name: cell division cycle 23
  Uniprot ID: Q9UJX2
  ENSP ID: ENSP00000378348
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLVRAILKCHSAFSETSIFRTNGKVKSFK

SEQ ID NO: 13692 - protein, 597 aa, Homo sapiens
  Payload ID: 2653
  Gene Symbol: CDC23
  Gene Name: cell division cycle 23
  Uniprot ID: Q9UJX2
  ENSP ID: ENSP00000378350
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 13693 - protein, 109 aa, Homo sapiens
  Payload ID: 2653
  Gene Symbol: CDC23
  Gene Name: cell division cycle 23
  ENSP ID: ENSP00000422505
MAASTSMVPVAVTAAVAPVLSINSDFSDLREIKKQLLLIAGLTRERGLLHSSKWKMPRIWMPIPWPRPTLTLKSMIGQHISCMAAIARKPIFCICIPDIWPPGKRTSEK

SEQ ID NO: 13694 - protein, 134 aa, Homo sapiens
  Payload ID: 2653
  Gene Symbol: CDC23
  Gene Name: cell division cycle 23
  ENSP ID: ENSP00000422902
  MOD_RES (1)..(1): Any amino acid
XSTSMVPVAVTAAVAPVLSINSDFSDLREIKKQLLLIAGLTRERGLLHSSKWSAELAFSLPALPLAELQPPPPITEMPRIWMPIPWPRPTLTLKSMIGQHISCMAAIARKPIFCICIPDICLEKKRRTMKQLIA

SEQ ID NO: 13695 - protein, 123 aa, Homo sapiens
  Payload ID: 2653
  Gene Symbol: CDC23
  Gene Name: cell division cycle 23
  ENSP ID: ENSP00000423704
MAASTSMVPVAVTAAVAPVLSINSDFSDLREIKKQLLLIAGLTRERGLLHSSKWSAELAFSLPALPLAELQPPPPITEMPRIWMPIPWPRPTLTLKSMIGQHISCMAAIARKPIFCICIPDIW

SEQ ID NO: 13696 - protein, 524 aa, Homo sapiens
  Payload ID: 2654
  Gene Symbol: CDC25A
  Gene Name: cell division cycle 25A
  Uniprot ID: P30304
  ENSP ID: ENSP00000303706
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 13697 - protein, 484 aa, Homo sapiens
  Payload ID: 2654
  Gene Symbol: CDC25A
  Gene Name: cell division cycle 25A
  Uniprot ID: P30304
  ENSP ID: ENSP00000343166
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 13698 - protein, 143 aa, Homo sapiens
  Payload ID: 2654
  Gene Symbol: CDC25A
  Gene Name: cell division cycle 25A
  ENSP ID: ENSP00000404285
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKEN

SEQ ID NO: 13699 - protein, 252 aa, Homo sapiens
  Payload ID: 2654
  Gene Symbol: CDC25A
  Gene Name: cell division cycle 25A
  ENSP ID: ENSP00000416483
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLV

SEQ ID NO: 13700 - protein, 580 aa, Homo sapiens
  Payload ID: 2655
  Gene Symbol: CDC25B
  Gene Name: cell division cycle 25B
  Uniprot ID: P30305
  ENSP ID: ENSP00000245960
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 13701 - protein, 516 aa, Homo sapiens
  Payload ID: 2655
  Gene Symbol: CDC25B
  Gene Name: cell division cycle 25B
  ENSP ID: ENSP00000339125
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 13702 - protein, 539 aa, Homo sapiens
  Payload ID: 2655
  Gene Symbol: CDC25B
  Gene Name: cell division cycle 25B
  Uniprot ID: P30305
  ENSP ID: ENSP00000339170
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 13703 - protein, 489 aa, Homo sapiens
  Payload ID: 2655
  Gene Symbol: CDC25B
  Gene Name: cell division cycle 25B
  ENSP ID: ENSP00000368918
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 13704 - protein, 566 aa, Homo sapiens
  Payload ID: 2655
  Gene Symbol: CDC25B
  Gene Name: cell division cycle 25B
  Uniprot ID: P30305
  ENSP ID: ENSP00000405972
MEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 13705 - protein, 473 aa, Homo sapiens
  Payload ID: 2656
  Gene Symbol: CDC25C
  Gene Name: cell division cycle 25C
  Uniprot ID: P30307
  ENSP ID: ENSP00000321656
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 13706 - protein, 400 aa, Homo sapiens
  Payload ID: 2656
  Gene Symbol: CDC25C
  Gene Name: cell division cycle 25C
  Uniprot ID: P30307
  ENSP ID: ENSP00000345205
MSTELFSSTREEGSSGSGPSFRSNQRKMLNLLLERDTSFTVCPDVPRTPVGKFLGDSANLSILSGSPGFFRTSGSAFSWDDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 13707 - protein, 400 aa, Homo sapiens; identical to SEQ ID NO: 13706
  Payload ID: 2656
  Gene Symbol: CDC25C
  Gene Name: cell division cycle 25C
  Uniprot ID: P30307
  ENSP ID: ENSP00000392631

SEQ ID NO: 13708 - protein, 258 aa, Homo sapiens
  Payload ID: 2656
  Gene Symbol: CDC25C
  Gene Name: cell division cycle 25C
  ENSP ID: ENSP00000423525
  MOD_RES (1)..(1): Any amino acid
XSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVSRFLEMVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEG

SEQ ID NO: 13709 - protein, 473 aa, Homo sapiens; identical to SEQ ID NO: 13705
  Payload ID: 2656
  Gene Symbol: CDC25C
  Gene Name: cell division cycle 25C
  Uniprot ID: P30307
  ENSP ID: ENSP00000424795

SEQ ID NO: 13710 - protein, 443 aa, Homo sapiens
  Payload ID: 2656
  Gene Symbol: CDC25C
  Gene Name: cell division cycle 25C
  Uniprot ID: P30307
  ENSP ID: ENSP00000425470
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 13711 - protein, 170 aa, Homo sapiens
  Payload ID: 2656
  Gene Symbol: CDC25C
  Gene Name: cell division cycle 25C
  ENSP ID: ENSP00000427105
MSEEARFCFSPGENSKTMSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKEN

SEQ ID NO: 13712 - protein, 249 aa, Homo sapiens
  Payload ID: 2656
  Gene Symbol: CDC25C
  Gene Name: cell division cycle 25C
  ENSP ID: ENSP00000427251
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQ

SEQ ID NO: 13713 - protein, 85 aa, Homo sapiens
  Payload ID: 2657
  Gene Symbol: CDC26
  Gene Name: cell division cycle 26
  Uniprot ID: Q8NHZ8
  ENSP ID: ENSP00000363322
MLRRKPTRLELKLDDIEEFENIRKDLETRKKQKEDVEVVGGSDGEGAIGLSSDPKSREQMINDRIGYKPQPKPNNRSSQFGSLEF

SEQ ID NO: 13714 - protein, 824 aa, Homo sapiens
  Payload ID: 2658
  Gene Symbol: CDC27
  Gene Name: cell division cycle 27
  Uniprot ID: P30260
  ENSP ID: ENSP00000066544
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 13715 - protein, 343 aa, Homo sapiens
  Payload ID: 2658
  Gene Symbol: CDC27
  Gene Name: cell division cycle 27
  ENSP ID: ENSP00000432105
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKVWFRNDLLQARKIQPCRNAFPKSA

SEQ ID NO: 13716 - protein, 94 aa, Homo sapiens
  Payload ID: 2658
  Gene Symbol: CDC27
  Gene Name: cell division cycle 27
  ENSP ID: ENSP00000432211
MTVLQEPVQAAIWQALNHYAYRDAVFLAERLYAEGLQKGNKSYLVECLISRKAMMILLLSLVIQLALLFHCWDMYIARQIGLPKDQNVTKRALV

SEQ ID NO: 13717 - protein, 830 aa, Homo sapiens
  Payload ID: 2658
  Gene Symbol: CDC27
  Gene Name: cell division cycle 27
  Uniprot ID: P30260
  ENSP ID: ENSP00000434614
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKTFRVLQSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 13718 - protein, 823 aa, Homo sapiens
  Payload ID: 2658
  Gene Symbol: CDC27
  Gene Name: cell division cycle 27
  ENSP ID: ENSP00000437339
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 13719 - protein, 59 aa, Homo sapiens
  Payload ID: 2658
  Gene Symbol: CDC27
  Gene Name: cell division cycle 27
  ENSP ID: ENSP00000458904
  MOD_RES (1)..(1): Any amino acid
XVTEFGDSACFTLSLLGHVYCKTDRLAKGSECYQKSLSLNPFLWSPFESLCEIVLGFCH

SEQ ID NO: 13720 - protein, 103 aa, Homo sapiens
  Payload ID: 2658
  Gene Symbol: CDC27
  Gene Name: cell division cycle 27
  ENSP ID: ENSP00000459307
  MOD_RES (1)..(1): Any amino acid
XETVLTETPQDTIELNRLNLESSNSKYSLNTDSSVSYIDSAVISPDTVPLGTGTSILSKQVQNKPKTGRSLLGGPAALSPLTPRPSNLSILLLYICLDDFLTP

SEQ ID NO: 13721 - protein, 86 aa, Homo sapiens
  Payload ID: 2658
  Gene Symbol: CDC27
  Gene Name: cell division cycle 27
  ENSP ID: ENSP00000460061
LFLLATCYYRSGKAYKAYRLLKGHSCTTPQCKYLLAKCCVDLSKLAEGEQILSGGVFNKQKSHDDIVTEFGDSACFTLSLLGHVYW

SEQ ID NO: 13722 - protein, 113 aa, Homo sapiens
  Payload ID: 2658
  Gene Symbol: CDC27
  Gene Name: cell division cycle 27
  ENSP ID: ENSP00000460132
  MOD_RES (1)..(1): Any amino acid
XKSKTNKGGITQPNINDSLEITKLDSSIISEGKISTITPQIQAFNLQKAAAGLMSLLREMGKGYLALCSYNCKEAINILSHLPSHHYNTGWVLCQIGRAYFELSEYMQTFSGS

SEQ ID NO: 13723 - protein, 163 aa, Homo sapiens
  Payload ID: 2658
  Gene Symbol: CDC27
  Gene Name: cell division cycle 27
  ENSP ID: ENSP00000460279
  MOD_RES (1)..(1): Any amino acid
XGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKILKEPITRLKRQLISVIFQMMRSQ

SEQ ID NO: 13724 - protein, 75 aa, Homo sapiens
  Payload ID: 2658
  Gene Symbol: CDC27
  Gene Name: cell division cycle 27
  ENSP ID: ENSP00000460424
  MOD_RES (1)..(1): Any amino acid
XYRDAVFLAERLYAEGLQKGNKSYLVECLISRKAMMILLLSLVIQLALLFHCWDMYIARQIGLPKDQNVTKRALV

SEQ ID NO: 13725 - protein, 233 aa, Homo sapiens
  Payload ID: 2658
  Gene Symbol: CDC27
  Gene Name: cell division cycle 27
  ENSP ID: ENSP00000460454
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIVQNKPKTGRSLLGGPAALSPLTP

SEQ ID NO: 13726 - protein, 33 aa, Homo sapiens
  Payload ID: 2658
  Gene Symbol: CDC27
  Gene Name: cell division cycle 27
  ENSP ID: ENSP00000460830
  MOD_RES (1)..(1): Any amino acid
XIGKCCCLFLGLQEVRSNAPRPDEFLLGYGFRS

SEQ ID NO: 13727 - protein, 52 aa, Homo sapiens
  Payload ID: 2658
  Gene Symbol: CDC27
  Gene Name: cell division cycle 27
  ENSP ID: ENSP00000466424
MTVLQEPVQAAIWQALNHYAYRDAVFLAERLYAEARQIGLPKDQNVTKRALV

SEQ ID NO: 13728 - protein, 236 aa, Homo sapiens
  Payload ID: 2659
  Gene Symbol: CDC34
  Gene Name: cell division cycle 34
  Uniprot ID: P49427
  ENSP ID: ENSP00000215574
MARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 13729 - protein, 146 aa, Homo sapiens
  Payload ID: 2659
  Gene Symbol: CDC34
  Gene Name: cell division cycle 34
  ENSP ID: ENSP00000475282
  MOD_RES (1)..(1): Any amino acid
XEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRRSWGPRWTRSVTA

SEQ ID NO: 13730 - protein, 119 aa, Homo sapiens
  Payload ID: 2659
  Gene Symbol: CDC34
  Gene Name: cell division cycle 34
  ENSP ID: ENSP00000475610
ARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRSWGPRWTRSVTA

SEQ ID NO: 13731 - protein, 107 aa, Homo sapiens
  Payload ID: 2659
  Gene Symbol: CDC34
  Gene Name: cell division cycle 34
  ENSP ID: ENSP00000476107
YFKARLKFPIDYPYSPPAFRFLTKMWHPNIYETGDVCISILHPPVDAERDGVKVPTTLAEYCVKTKAPAPDEGSDLFYDDYYEDGEVEEEADSCFGDDEDDSGTEES

SEQ ID NO: 13732 - protein, 378 aa, Homo sapiens
  Payload ID: 2660
  Gene Symbol: CDC37
  Gene Name: cell division cycle 37
  Uniprot ID: Q16543
  ENSP ID: ENSP00000222005
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 13733 - protein, 104 aa, Homo sapiens
  Payload ID: 2660
  Gene Symbol: CDC37
  Gene Name: cell division cycle 37
  ENSP ID: ENSP00000464889
  MOD_RES (1)..(1): Any amino acid
XNDELEAFKERVRGRAKLRIEKAMKEYEEEERKKRLGPGGLDPVEVYESLPEELQKCFDVKDVQMLQDAISKMDPTVSNPRAPCLPGGPCVSPSPVSQVSEAGW

SEQ ID NO: 13734 - protein, 60 aa, Homo sapiens
  Payload ID: 2660
  Gene Symbol: CDC37
  Gene Name: cell division cycle 37
  ENSP ID: ENSP00000464971
MVDYSVWDHIEVSDDEDETHPNIDTASLFRWRHQTGPCFVTLRWQWRHLSSLQLPPSGLK

SEQ ID NO: 13735 - protein, 353 aa, Homo sapiens
  Payload ID: 2660
  Gene Symbol: CDC37
  Gene Name: cell division cycle 37
  ENSP ID: ENSP00000465724
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKAHAHAPATLMLMASSPPPPWMGWALRPRPARPRSRRSAALPQPTPPLTLPQSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLP

SEQ ID NO: 13736 - protein, 184 aa, Homo sapiens
  Payload ID: 2660
  Gene Symbol: CDC37
  Gene Name: cell division cycle 37
  ENSP ID: ENSP00000465941
  MOD_RES (1)..(1): Any amino acid
XYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEELQKCFDVKDVQMLQDAISKMDPTDAKYHMQRCIDSGLWVPNSKASEAKEGEEAGPGDPLLEAVPKTGDEKDVSV

SEQ ID NO: 13737 - protein, 230 aa, Homo sapiens
  Payload ID: 2660
  Gene Symbol: CDC37
  Gene Name: cell division cycle 37
  ENSP ID: ENSP00000467747
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEFFTKIKTADRQYMEGFNDELEAFKERVRGRAKLRIEKAMKEYEEEERKKRLGPGGLDPVEVYESLPEELQKCFDVKDVQMLQDAISKM

SEQ ID NO: 13738 - protein, 337 aa, Homo sapiens
  Payload ID: 2661
  Gene Symbol: CDC37L1
  Gene Name: cell division cycle 37-like 1
  Uniprot ID: Q7L3B6
  ENSP ID: ENSP00000371278
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHFGMLSRWDDSQRFLSDHPYLVCEETAKYLILWCFHLEAEKKGALMEQIAHQAVVMQFIMEMAKNCNVDPRGCFRLFFQKAKAEEEGYFEAFKNELEAFKSRVRLYSQSQSFQPMTVQNHVPHSGVGSIGLLESLPQNPDYLQYSISTALCSLNSVVHKEDDEPKMMDTV

SEQ ID NO: 13739 - protein, 308 aa, Homo sapiens
  Payload ID: 2661
  Gene Symbol: CDC37L1
  Gene Name: cell division cycle 37-like 1
  ENSP ID: ENSP00000371282
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHFGMLSRWDDSQRFLSDHPYLVCEETAKYLILWCFHLEAEKKGALMEQIAHQAVVMQFIMEMAKNCNVDPRGCFRLFFQKAKAEEEGYFEAFKNELEAFKSRVRLYSQSQSFQPMTVQNHVPHSGVGSIGLLESLPQAPRF

SEQ ID NO: 13740 - protein, 579 aa, Homo sapiens
  Payload ID: 2662
  Gene Symbol: CDC40
  Gene Name: cell division cycle 40
  Uniprot ID: O60508
  ENSP ID: ENSP00000304370
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 13741 - protein, 539 aa, Homo sapiens
  Payload ID: 2662
  Gene Symbol: CDC40
  Gene Name: cell division cycle 40
  ENSP ID: ENSP00000357926
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMRVPQSFQNLKEVTAGPQEG

SEQ ID NO: 13742 - protein, 579 aa, Homo sapiens; identical to SEQ ID NO: 13740
  Payload ID: 2662
  Gene Symbol: CDC40
  Gene Name: cell division cycle 40
  Uniprot ID: O60508
  ENSP ID: ENSP00000357928

SEQ ID NO: 13743 - protein, 191 aa, Homo sapiens
  Payload ID: 2663
  Gene Symbol: CDC42
  Gene Name: cell division cycle 42
  Uniprot ID: P60953
  ENSP ID: ENSP00000314458
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 13744 - protein, 191 aa, Homo sapiens
  Payload ID: 2663
  Gene Symbol: CDC42
  Gene Name: cell division cycle 42
  Uniprot ID: P60953
  ENSP ID: ENSP00000341072
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 13745 - protein, 191 aa, Homo sapiens; identical to SEQ ID NO: 13744
  Payload ID: 2663
  Gene Symbol: CDC42
  Gene Name: cell division cycle 42
  Uniprot ID: P60953
  ENSP ID: ENSP00000383118

SEQ ID NO: 13746 - protein, 136 aa, Homo sapiens
  Payload ID: 2663
  Gene Symbol: CDC42
  Gene Name: cell division cycle 42
  ENSP ID: ENSP00000398327
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKP

SEQ ID NO: 13747 - protein, 566 aa, Homo sapiens
  Payload ID: 2664
  Gene Symbol: CDC45
  Gene Name: cell division cycle 45
  Uniprot ID: O75419
  ENSP ID: ENSP00000263201
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 13748 - protein, 520 aa, Homo sapiens
  Payload ID: 2664
  Gene Symbol: CDC45
  Gene Name: cell division cycle 45
  Uniprot ID: O75419
  ENSP ID: ENSP00000384978
MFVSDFRKEFYEVVQSQRVLLFVASDVDALCACKILQALFQCDHVQYTLVPVSGWQELETAFLEHKEQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 13749 - protein, 566 aa, Homo sapiens; identical to SEQ ID NO: 13747
  Payload ID: 2664
  Gene Symbol: CDC45
  Gene Name: cell division cycle 45
  Uniprot ID: O75419
  ENSP ID: ENSP00000385240

SEQ ID NO: 13750 - protein, 96 aa, Homo sapiens
  Payload ID: 2664
  Gene Symbol: CDC45
  Gene Name: cell division cycle 45
  ENSP ID: ENSP00000388280
  MOD_RES (1)..(1): Any amino acid
XDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRIIY

SEQ ID NO: 13751 - protein, 159 aa, Homo sapiens
  Payload ID: 2664
  Gene Symbol: CDC45
  Gene Name: cell division cycle 45
  ENSP ID: ENSP00000397434
MLPHWRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRR

SEQ ID NO: 13752 - protein, 598 aa, Homo sapiens
  Payload ID: 2664
  Gene Symbol: CDC45
  Gene Name: cell division cycle 45
  Uniprot ID: O75419
  ENSP ID: ENSP00000405726
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARSGSGSEPVAAALEKSSRLFAGPMSDRTAPRSPRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 13753 - protein, 112 aa, Homo sapiens
  Payload ID: 2664
  Gene Symbol: CDC45
  Gene Name: cell division cycle 45
  ENSP ID: ENSP00000413138
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYND

SEQ ID NO: 13754 - protein, 802 aa, Homo sapiens
  Payload ID: 2665
  Gene Symbol: CDC5L
  Gene Name: cell division cycle 5-like
  Uniprot ID: Q99459
  ENSP ID: ENSP00000360532
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 13755 - protein, 560 aa, Homo sapiens
  Payload ID: 2666
  Gene Symbol: CDC6
  Gene Name: cell division cycle 6
  Uniprot ID: Q99741
  ENSP ID: ENSP00000209728
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQNKILSSVRKSQEITTNSEQRCPLKKESACVRLFKQEGTCYQQAKLVLNTAVPDRLPAREREMDVIRNFLREHICGKKAGSLYLSGAPGTGKTACLSRILQDLKKELKGFKTIMLNCMSLRTAQAVFPAIAQEICQEEVSRPAGKDMMRKLEKHMTAEKGPMIVLVLDEMDQLDSKGQDVLYTLFEWPWLSNSHLVLIGIANTLDLTDRILPRLQAREKCKPQLLNFPPYTRNQIVTILQDRLNQVSRDQVLDNAAVQFCARKVSAVSGDVRKALDVCRRAIEIVESDVKSQTILKPLSECKSPSEPLIPKRVGLIHISQVISEVDGNRMTLSQEGAQDSFPLQQKILVCSLMLLIRQLKIKEVTLGKLYEAYSKVCRKQQVAAVDQSECLSLSGLLEARGILGLKRNKETRLTKVFFKIEEKEIEHALKDKALIGNILATGLP

SEQ ID NO: 13756 - protein, 100 aa, Homo sapiens
  Payload ID: 2666
  Gene Symbol: CDC6
  Gene Name: cell division cycle 6
  ENSP ID: ENSP00000463004
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDN

SEQ ID NO: 13757 - protein, 182 aa, Homo sapiens
  Payload ID: 2666
  Gene Symbol: CDC6
  Gene Name: cell division cycle 6
  ENSP ID: ENSP00000463635
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQNKILSSVRKSQEITTNSEQRCPLKKESACVRLFKQEGTCYQQAKLVLNTAVPDRLPAREREMDVI

SEQ ID NO: 13758 - protein, 118 aa, Homo sapiens
  Payload ID: 2666
  Gene Symbol: CDC6
  Gene Name: cell division cycle 6
  ENSP ID: ENSP00000464047
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQN

SEQ ID NO: 13759 - protein, 574 aa, Homo sapiens
  Payload ID: 2667
  Gene Symbol: CDC7
  Gene Name: cell division cycle 7
  Uniprot ID: O00311
  ENSP ID: ENSP00000234626
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 13760 - protein, 574 aa, Homo sapiens; identical to SEQ ID NO: 13759
  Payload ID: 2667
  Gene Symbol: CDC7
  Gene Name: cell division cycle 7
  Uniprot ID: O00311
  ENSP ID: ENSP00000393139

SEQ ID NO: 13761 - protein, 157 aa, Homo sapiens
  Payload ID: 2667
  Gene Symbol: CDC7
  Gene Name: cell division cycle 7
  ENSP ID: ENSP00000398077
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREY

SEQ ID NO: 13762 - protein, 531 aa, Homo sapiens
  Payload ID: 2668
  Gene Symbol: CDC73
  Gene Name: cell division cycle 73
  Uniprot ID: Q6P1J9
  ENSP ID: ENSP00000356405
MADVLSVLRQYNIQKKEIVVKGDEVIFGEFSWPKNVKTNYVVWGTGKEGQPREYYTLDSILFLLNNVHLSHPVYVRRAATENIPVVRRPDRKDLLGYLNGEASTSASIDRSAPLEIGLQRSTQVKRAADEVLAEAKKPRIEDEECVRLDKERLAARLEGHKEGIVQTEQIRSLSEAMSVEKIAAIKAKIMAKKRSTIKTDLDDDITALKQRSFVDAEVDVTRDIVSRERVWRTRTTILQSTGKNFSKNIFAILQSVKAREEGRAPEQRPAPNAAPVDPTLRTKQPIPAAYNRYDQERFKGKEETEGFKIDTMGTYHGMTLKSVTEGASARKTQTPAAQPVPRPVSQARPPPNQKKGSRTPIIIIPAATTSLITMLNAKDLLQDLKFVPSDEKKKQGCQRENETLIQRRKDQMQPGGTAISVTVPYRVVDQPLKLMPQDWDRVVAVFVQGPAWQFKGWPWLLPDGSPVDIFAKIKAFHLKYDEVRLDPNVQKWDVTVLELSYHKRHLDRPVFLRFWETLDRYMVKHKSHLRF

SEQ ID NO: 13763 - protein, 1150 aa, Homo sapiens
  Payload ID: 2669
  Gene Symbol: CCAR1
  Gene Name: cell division cycle and apoptosis regulator 1
  Uniprot ID: Q8IX12
  ENSP ID: ENSP00000265872
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 13764 - protein, 568 aa, Homo sapiens
  Payload ID: 2669
  Gene Symbol: CCAR1
  Gene Name: cell division cycle and apoptosis regulator 1
  ENSP ID: ENSP00000437760
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWMKKRRMMVKLKKFLHLPIGLNLIQRQ

SEQ ID NO: 13765 - protein, 772 aa, Homo sapiens
  Payload ID: 2669
  Gene Symbol: CCAR1
  Gene Name: cell division cycle and apoptosis regulator 1
  ENSP ID: ENSP00000438610
MAQFGGQKNPPWATQFTATAVSQPAALGVQQPSLLGASPTIYTQQTALAAAGLTTQTPANYQLTQTAALQQQAAAAAAALQQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKED

SEQ ID NO: 13766 - protein, 119 aa, Homo sapiens
  Payload ID: 2669
  Gene Symbol: CCAR1
  Gene Name: cell division cycle and apoptosis regulator 1
  ENSP ID: ENSP00000438881
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSL

SEQ ID NO: 13767 - protein, 290 aa, Homo sapiens
  Payload ID: 2669
  Gene Symbol: CCAR1
  Gene Name: cell division cycle and apoptosis regulator 1
  ENSP ID: ENSP00000438939
  MOD_RES (1)..(1): Any amino acid
XSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDML

SEQ ID NO: 13768 - protein, 568 aa, Homo sapiens; identical to SEQ ID NO: 13764
  Payload ID: 2669
  Gene Symbol: CCAR1
  Gene Name: cell division cycle and apoptosis regulator 1
  ENSP ID: ENSP00000439153

SEQ ID NO: 13769 - protein, 1043 aa, Homo sapiens
  Payload ID: 2669
  Gene Symbol: CCAR1
  Gene Name: cell division cycle and apoptosis regulator 1
  ENSP ID: ENSP00000439252
MAQFGGQKNPPWATQFTATAVSQPAALGVQQPSLLGASPTIYTQQTALAAAGLTTQTPANYQLTQTAALQQQAAAAAAALQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLL

SEQ ID NO: 13770 - protein, 84 aa, Homo sapiens
  Payload ID: 2669
  Gene Symbol: CCAR1
  Gene Name: cell division cycle and apoptosis regulator 1
  ENSP ID: ENSP00000439571
MAQFGGQKNPPWATQFTATAVSQPAALGVQQPSLLGASPTIYTQQTALAAAGLTTQTPANYQLTQTAALQQQAAAAAAALQQHK

SEQ ID NO: 13771 - protein, 646 aa, Homo sapiens
  Payload ID: 2669
  Gene Symbol: CCAR1
  Gene Name: cell division cycle and apoptosis regulator 1
  ENSP ID: ENSP00000439642
MPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKED

SEQ ID NO: 13772 - protein, 48 aa, Homo sapiens
  Payload ID: 2669
  Gene Symbol: CCAR1
  Gene Name: cell division cycle and apoptosis regulator 1
  ENSP ID: ENSP00000440224
  MOD_RES (1)..(1): Any amino acid
XTAIRCCKALTGIDLSVCTQWHRNTGTNAHHTLHNKHTWRNITGNSDW

SEQ ID NO: 13773 - protein, 171 aa, Homo sapiens
  Payload ID: 2669
  Gene Symbol: CCAR1
  Gene Name: cell division cycle and apoptosis regulator 1
  ENSP ID: ENSP00000442410
MAQFGGQKNPPWATQFTATAVSQPAALGVQQPSLLGASPTIYTQQTALAAAGLTTQTPANYQLTQTAALQQQAAAAAAALQQQYSQPQQALYSVQQQLQQPQQTLLTQPAVALPTSLSLSTPQPTAQITVSYPTPRSSQQQTQPQKQRVFTGVVTKLHDTFGFVDEDVFFQ

SEQ ID NO: 13774 - protein, 95 aa, Homo sapiens
  Payload ID: 2669
  Gene Symbol: CCAR1
  Gene Name: cell division cycle and apoptosis regulator 1
  ENSP ID: ENSP00000443808
MATLQSAAPLLPSRCGFTLLAPRPGTSWRLPAAWVLGNRGFLHRCYRRQTREGFFSFCIMAQFGGQKNPPWATQFTATAVSQPAALGVQQPSLLG

SEQ ID NO: 13775 - protein, 1135 aa, Homo sapiens
  Payload ID: 2669
  Gene Symbol: CCAR1
  Gene Name: cell division cycle and apoptosis regulator 1
  Uniprot ID: Q8IX12
  ENSP ID: ENSP00000445254
MAQFGGQKNPPWATQFTATAVSQPAALGVQQPSLLGASPTIYTQQTALAAAGLTTQTPANYQLTQTAALQQQAAAAAAALQQLQQPQQTLLTQPAVALPTSLSLSTPQPTAQITVSYPTPRSSQQQTQPQKQRVFTGVVTKLHDTFGFVDEDVFFQLSAVKGKTPQVGDRVLVEATYNPNMPFKWNAQRIQTLPNQNQSQTQPLLKTPPAVLQPIAPQTTFGVQTQPQPQSLLQAQISAASITPLLQTQPQPLLQQPQQKAGLLQPPVRIVSQPQPARRLDPPSRFSGRNDRGDQVPNRKDDRSRERERERRRSRERSPQRKRSRERSPRRERERSPRRVRRVVPRYTVQFSKFSLDCPSCDMMELRRRYQNLYIPSDFFDAQFTWVDAFPLSRPFQLGNYCNFYVMHREVESLEKNMAILDPPDADHLYSAKVMLMASPSMEDLYHKSCALAEDPQELRDGFQHPARLVKFLVGMKGKDEAMAIGGHWSPSLDGPDPEKDPSVLIKTAIRCCKALTGIDLSVCTQWYRFAEIRYHRPEETHKGRTVPAHVETVVLFFPDVWHCLPTRSEWETLSRGYKQQLVEKLQGERKEADGEQDEEEKDDGEAKEISTPTHWSKLDPKTMKVNDLRKELESRALSSKGLKSQLIARLTKQLKVEEQKEEQKELEKSEKEEDEDDDRKSEDDKEEEERKRQEEIERQRRERRYILPDEPAIIVHPNWAAKSGKFDCSIMSLSVLLDYRLEDNKEHSFEVSLFAELFNEMLQRDFGVRIYKSLLSLPEKEDKKEKDKKSKKDERKDKKEERDDETDEPKPKRRKSGDDKDKKEDRDERKKEDKRKDDSKDDDETEEDNNQDEYDPMEAEEAEDEEDDRDEEEMTKRDDKRDINRYCKERPSKDKEKEKTQMITINRDLLMAFVYFDQSHCGYLLEKDLEEILYTLGLHLSRAQVKKLLNKVVLRESCFYRKLTDTSKDEENHEESESLQEDMLGNRLLLPTPTVKQESKDVEENVGLIVYNGAMVDVGSLLQKLEKSEKVRAEVEQKLQLLEEKTDEDEKTILNLENSNKSLSGELREVKKDLSQLQENLKISENMNLQFENQMNKTIRNLSTVMDEIHTVLKKDNVKNEDKDQKSKENGASV

SEQ ID NO: 13776 - protein, 568 aa, Homo sapiens; identical to SEQ ID NO: 13764
  Payload ID: 2669
  Gene Symbol: CCAR1
  Gene Name: cell division cycle and apoptosis regulator 1
  ENSP ID: ENSP00000486408

SEQ ID NO: 13777 - protein, 1023 aa, Homo sapiens
  Payload ID: 2670
  Gene Symbol: CDCA2
  Gene Name: cell division cycle associated 2
  Uniprot ID: Q69YH5
  ENSP ID: ENSP00000328228
MDANSKDKPPETKESAMNNAGNASFILGTGKIVTPQKHAELPPNPCTPDTFKSPLNFSTVTVEQLGITPESFVRNSAGKSSSYLKKCRRRSAVGARGSPETNHLIRFIARQQNIKNARKSPLAQDSPSQGSPALYRNVNTLRERISAFQSAFHSIKENEKMTGCLEFSEAGKESEMTDLTRKEGLSACQQSGFPAVLSSKRRRISYQRDSDENLTDAEGKVIGLQIFNIDTDRACAVETSVDLSEISSKLGSTQSGFLVEESLPLSELTETSNALKVADCVVGKGSSDAVSPDTFTAEVSSDAVPDVRSPATPACRRDLPTPKTFVLRSVLKKPSVKMCLESLQEHCNNLYDDDGTHPSLISNLPNCCKEKEAEDEENFEAPAFLNMRKRKRVTFGEDLSPEVFDESLPANTPLRKGGTPVCKKDFSGLSSLLLEQSPVPEPLPQPDFDDKGENLENIEPLQVSFAVLSSPNKSSISETLSGTDTFSSSNNHEKISSPKVGRITRTSNRRNQLVSVVEESVCNLLNTEVQPCKEKKINRRKSQETKCTKRALPKKSQVLKSCRKKKGKGKKSVQKSLYGERDIASKKPLLSPIPELPEVPEMTPSIPSIRRLGSGYFSSNGKLEEVKTPKNPVKRKDLLRHDPDLHMHQGYDKYDVSEFCSYIKSSSSLGNATSDEDPNTNIMNINENKNIPKAKNKSESENEPKAGTDSPVSCASVTEERVASDSPKPALTLQQGQEFSAGGQNAENLCQFFKISPDLNIKCERKDDFLGAAEGKLQCNRLMPNSQKDCHCLGDVLIENTKESKSQSEDLGRKPMESSSVVSCRDRKDRRRSMCYSDGRSLHLEKNGNHTPSSSVGSSVEISLENSELFKDLSDAIEQTFQRRNSETKVRRSTRLQKDLENEGLVWISLPLPSTSQKAKRRTICTFDSSGFESMSPIKETVSSRQKPQMAPPVSDPENSQGPAAGSSDEPGKRRKSFCISTLANTKATSQFKGYRRRSSLNGKGESSLTALERIEHNGERKQ

SEQ ID NO: 13778 - protein, 1008 aa, Homo sapiens
  Payload ID: 2670
  Gene Symbol: CDCA2
  Gene Name: cell division cycle associated 2
  ENSP ID: ENSP00000370040
MSSVSGNASFILGTGKIVTPQKHAELPPNPCTPDTFKSPLNFSTVTVEQLGITPESFVRNSAGKSSSYLKKCRRRSAVGARGSPETNHLIRFIARQQNIKNARKSPLAQDSPSQGSPALYRNVNTLRERISAFQSAFHSIKENEKMTGCLEFSEAGKESEMTDLTRKEGLSACQQSGFPAVLSSKRRRISYQRDSDENLTDAEGKVIGLQIFNIDTDRACAVETSVDLSEISSKLGSTQSGFLVEESLPLSELTETSNALKVADCVVGKGSSDAVSPDTFTAEVSSDAVPDVRSPATPACRRDLPTPKTFVLRSVLKKPSVKMCLESLQEHCNNLYDDDGTHPSLISNLPNCCKEKEAEDEENFEAPAFLNMRKRKRVTFGEDLSPEVFDESLPANTPLRKGGTPVCKKDFSGLSSLLLEQSPVPEPLPQPDFDDKGENLENIEPLQVSFAVLSSPNKSSISETLSGTDTFSSSNNHEKISSPKVGRITRTSNRRNQLVSVVEESVCNLLNTEVQPCKEKKINRRKSQETKCTKRALPKKSQVLKSCRKKKGKGKKSVQKSLYGERDIASKKPLLSPIPELPEVPEMTPSIPSIRRLGSGYFSSNGKLEEVKTPKNPVKRKDLLRHDPDLHMHQGYDKYDVSEFCSYIKSSSSLGNATSDEDPNTNIMNINENKNIPKAKNKSESENEPKAGTDSPVSCASVTEERVASDSPKPALTLQQGQEFSAGGQNAENLCQFFKISPDLNIKCERKDDFLGAAEGKLQCNRLMPNSQKDCHCLGDVLIENTKESKSQSEDLGRKPMESSSVVSCRDRKDRRRSMCYSDGRSLHLEKNGNHTPSSSVGSSVEISLENSELFKDLSDAIEQTFQRRNSETKVRRSTRLQKDLENEGLVWISLPLPSTSQKAKRRTICTFDSSGFESMSPIKETVSSRQKPQMAPPVSDPENSQGPAAGSSDEPGKRRKSFCISTLANTKATSQFKGYRRRSSLNGKGESSLTALERIEHNGERKQ

SEQ ID NO: 13779 - protein, 243 aa, Homo sapiens
  Payload ID: 2671
  Gene Symbol: CDCA3
  Gene Name: cell division cycle associated 3
  ENSP ID: ENSP00000229265
MGSAKSVPVTPARPPPHNKHLARVADPRSPSAGILRTPIQVESSPQPGLPAGEQLEGLKHAQDSDPRSPTLGIARTPMKTSSGEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 13780 - protein, 219 aa, Homo sapiens
  Payload ID: 2671
  Gene Symbol: CDCA3
  Gene Name: cell division cycle associated 3
  ENSP ID: ENSP00000415142
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSASSVPDFEEAVPGTCGHSHPVSCDSQAAHPVIVAREDA

SEQ ID NO: 13781 - protein, 182 aa, Homo sapiens
  Payload ID: 2671
  Gene Symbol: CDCA3
  Gene Name: cell division cycle associated 3
  ENSP ID: ENSP00000441120
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSG

SEQ ID NO: 13782 - protein, 268 aa, Homo sapiens
  Payload ID: 2671
  Gene Symbol: CDCA3
  Gene Name: cell division cycle associated 3
  Uniprot ID: Q99618
  ENSP ID: ENSP00000442068
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSGSMRNRWKPNSSKVLGRSPLTILQDDNSPGTLTLRQGKRPSPLSENVSELKEGAILGTGRLLKTGGRAWEQGQDHDKENQHFPLVES

SEQ ID NO: 13783 - protein, 268 aa, Homo sapiens; identical to SEQ ID NO: 13782
  Payload ID: 2671
  Gene Symbol: CDCA3
  Gene Name: cell division cycle associated 3
  Uniprot ID: Q99618
  ENSP ID: ENSP00000446339

SEQ ID NO: 13784 - protein, 241 aa, Homo sapiens
  Payload ID: 2672
  Gene Symbol: CDCA4
  Gene Name: cell division cycle associated 4
  Uniprot ID: Q9BXL8
  ENSP ID: ENSP00000337226
MFARGLKRKCVGHEEDVEGALAGLKTVSSYSLQRQSLLDMSLVKLQLCHMLVEPNLCRSVLIANTVRQIQEEMTQDGTWRTVAPQAAERAPLDRLVSTEILCRAAWGQEGAHPAPGLGDGHTQGPVSDLCPVTSAQAPRHLQSSAWEMDGPRENRGSFHKSLDQIFETLETKNPSCMEELFSDVDSPYYDLDTVLTGMMGGARPGPCEGLEGLAPATPGPSSSCKSDLGELDHVVEILVET

SEQ ID NO: 13785 - protein, 241 aa, Homo sapiens; identical to SEQ ID NO: 13784
  Payload ID: 2672
  Gene Symbol: CDCA4
  Gene Name: cell division cycle associated 4
  Uniprot ID: Q9BXL8
  ENSP ID: ENSP00000376369

SEQ ID NO: 13786 - protein, 252 aa, Homo sapiens
  Payload ID: 2673
  Gene Symbol: CDCA5
  Gene Name: cell division cycle associated 5
  Uniprot ID: Q96FF9
  ENSP ID: ENSP00000275517
MSGRRTRSGGAAQRSGPRAPSPTKPLRRSQRKSGSELPSILPEIWPKTPSAAAVRKPIVLKRIVAHAVEVPAVQSPRRSPRISFFLEKENEPPGRELTKEDLFKTHSVPATPTSTPVPNPEAESSSKEGELDARDLEMSKKVRRSYSRLETLGSASTSTPGRRSCFGFEGLLGAEDLSGVSPVVCSKLTEVPRVCAKPWAPDMTLPGISPPPEKQKRKKKKMPEILKTELDEWAAAMNAEFEAAEQFDLLVE

SEQ ID NO: 13787 - protein, 307 aa, Homo sapiens
  Payload ID: 2673
  Gene Symbol: CDCA5
  Gene Name: cell division cycle associated 5
  ENSP ID: ENSP00000385711
MSGRRTRSGGAAQRSGPRAPSPTKPLRRSQRKSGSELPSILPEIWPKTPSAAAVRKPIVLKRIVAHAVEVPAVQSPRRSPRISFFLEKENEPPGRELTKEDLFKTHSVPATPTSTPVPNPEAESSSKEGELDARDLEMSKKVRRSYSRLETLGSASTSTPGRRSCFGFEGLLGAEDLSGVSPVVCSKLTEVPRVCAKPWAPDMTLPGISPPPEKQKRKKKKMPEILVSERQGFFSAVCSGRRAGLGLWLFWGIGSTCRVWVRCSSHHVPFSLTCSSFLFPQKTELDEWAAAMNAEFEAAEQFDLLVE

SEQ ID NO: 13788 - protein, 70 aa, Homo sapiens
  Payload ID: 2673
  Gene Symbol: CDCA5
  Gene Name: cell division cycle associated 5
  ENSP ID: ENSP00000431888
  MOD_RES (1)..(1): Any amino acid
XRKPIVLKRIVAHAVEVPAVQSPRRSPRAAGPALASRGCWGQKTCPESRQWCAPNSPRSPGFVQSPGPQT

SEQ ID NO: 13789 - protein, 254 aa, Homo sapiens
  Payload ID: 2673
  Gene Symbol: CDCA5
  Gene Name: cell division cycle associated 5
  ENSP ID: ENSP00000432183
  MOD_RES (1)..(1): Any amino acid
XQKRKKKKMPEILSLRGRQRAHSKLANKPVVQPVEEQEPKGPQASEERNLEPPSSEQLEPTVTFLFTLLNTSEPTEPKDPESDSEIQEYQFLDQEDWGPQRTSKEIRQLQNDCMRLRESLNTTQVHNLALGEKLQNLPTLLYKSLKEGAQAIQEEAQAIQDEVKALQEESQALPEVALLRCAGSHGSGEGRGGCPMLLTRAVSACSDPNPRKAGLLFKLPDLPHDHRDQGQAWPGPRPEVGHLLGRPLLQPAPP

SEQ ID NO: 13790 - protein, 224 aa, Homo sapiens
  Payload ID: 2673
  Gene Symbol: CDCA5
  Gene Name: cell division cycle associated 5
  ENSP ID: ENSP00000432342
PGISPPPEKQKRKKKKMPEILSLRGRQRAHSKLANKPVVQPVEEQEPKGPQASEERNLEPPSSEQLEPTVTFLFTLLNTSEPTEPKDPESDSEIQEYQFLDQEDWGPQRTSKEIRQLQNDCMRLRESLNTTQVHNLALGEKLQNLPTLLYKSLKEGAQAIQEEAQAIQDEVKALQEESQALPEVALLSDPNPRKAGLLFKLPDLPHDHRDQGQAWPGPRPEVGH

SEQ ID NO: 13791 - protein, 57 aa, Homo sapiens
  Payload ID: 2673
  Gene Symbol: CDCA5
  Gene Name: cell division cycle associated 5
  ENSP ID: ENSP00000432621
  MOD_RES (1)..(1): Any amino acid
XSGRRTRSGGAAQRSGPHLLLSLCGGPSGNQALNSRASSLKSGRRHPVRLQSESPSS

SEQ ID NO: 13792 - protein, 371 aa, Homo sapiens
  Payload ID: 2674
  Gene Symbol: CDCA7
  Gene Name: cell division cycle associated 7
  Uniprot ID: Q9BWT1
  ENSP ID: ENSP00000272789
MDARRVPQKDLRVKKNLKKFRYVKLISMETSSSSDDSCDSFASDNFANTRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 13793 - protein, 450 aa, Homo sapiens
  Payload ID: 2674
  Gene Symbol: CDCA7
  Gene Name: cell division cycle associated 7
  Uniprot ID: Q9BWT1
  ENSP ID: ENSP00000306968
MDARRVPQKDLRVKKNLKKFRYVKLISMETSSSSDDSCDSFASDNFANTKPKFRSDISEELANVFYEDSDNESFCGFSESEVQDVLDHCGFLQKPRPDVTNELAGIFHADSDDESFCGFSESEIQDGMRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 13794 - protein, 406 aa, Homo sapiens
  Payload ID: 2674
  Gene Symbol: CDCA7
  Gene Name: cell division cycle associated 7
  Uniprot ID: Q9BWT1
  ENSP ID: ENSP00000386656
MDARRVPQKDLRVKKNLKKFRYVKLISMETSSSSDDSCDSFASDNFANTKPRPDVTNELAGIFHADSDDESFCGFSESEIQDGMRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 13795 - protein, 329 aa, Homo sapiens
  Payload ID: 2674
  Gene Symbol: CDCA7
  Gene Name: cell division cycle associated 7
  Uniprot ID: Q9BWT1
  ENSP ID: ENSP00000386833
MDARRVPRLQSVREGCRTRSQCRHSGPLRVAMKFPARSTRGATNKKAESRQPSENSVTDSNSDSEDESGMNFLEKRALNIKQNKAMLAKLMSELESFPGSFRGRHPLPGSDSQSRRPRRRTFPGVASRRNPERRARPLTRSRSRILGSLDALPMEEEEEEDKYMLVRKRKTVDGYMNEDDLPRSRRSRSSVTLPHIIRPVEEITEEELENVCSNSREKIYNRSLGSTCHQCRQKTIDTKTNCRNPDCWGVRGQFCGPCLRNRYGEEVRDALLDPNWHCPPCRGICNCSFCRQRDGRCATGVLVYLAKYHGFGNVHAYLKSLKQEFEMQA

SEQ ID NO: 13796 - protein, 56 aa, Homo sapiens
  Payload ID: 2674
  Gene Symbol: CDCA7
  Gene Name: cell division cycle associated 7
  ENSP ID: ENSP00000390470
MDARRVPQKDLRVKKNLKKFRYVKLISMETSSSSDDSCDSFASDNFANTKVRCKMY

SEQ ID NO: 13797 - protein, 420 aa, Homo sapiens
  Payload ID: 2675
  Gene Symbol: CDCA7L
  Gene Name: cell division cycle associated 7-like
  Uniprot ID: Q96GN5
  ENSP ID: ENSP00000348523
METLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 13798 - protein, 408 aa, Homo sapiens
  Payload ID: 2675
  Gene Symbol: CDCA7L
  Gene Name: cell division cycle associated 7-like
  Uniprot ID: Q96GN5
  ENSP ID: ENSP00000363045
MELATRYQIPKEVADIFNAPSDDEEFVGFRDDVPMETLSSEESCDSFDSLESGKQVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 13799 - protein, 454 aa, Homo sapiens
  Payload ID: 2675
  Gene Symbol: CDCA7L
  Gene Name: cell division cycle associated 7-like
  Uniprot ID: Q96GN5
  ENSP ID: ENSP00000383986
MELATRYQIPKEVADIFNAPSDDEEFVGFRDDVPMETLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 13800 - protein, 98 aa, Homo sapiens
  Payload ID: 2675
  Gene Symbol: CDCA7L
  Gene Name: cell division cycle associated 7-like
  ENSP ID: ENSP00000400673
  MOD_RES (1)..(1): Any amino acid
XVTRAISVDKRPSTPRQCVGTRVAVVCEDSSVDHACGTAMGRMSDRHCWTRIGCVPPVVGSAIAATVGSVTAAVPQESSFIWPSFMVMTMLRNIWRGK

SEQ ID NO: 13801 - protein, 156 aa, Homo sapiens
  Payload ID: 2675
  Gene Symbol: CDCA7L
  Gene Name: cell division cycle associated 7-like
  ENSP ID: ENSP00000406616
MELATRYQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDS

SEQ ID NO: 13802 - protein, 96 aa, Homo sapiens
  Payload ID: 2675
  Gene Symbol: CDCA7L
  Gene Name: cell division cycle associated 7-like
  ENSP ID: ENSP00000410014
METLSSEESCDSFDSLESGKQQDVRFHSKYFTEELRRIFIEDTDSETEDFAGFTQSDLNGKTNPEVMVVESDLSDDGKASLVSEEEEDEEEDKATP

SEQ ID NO: 13803 - protein, 113 aa, Homo sapiens
  Payload ID: 2675
  Gene Symbol: CDCA7L
  Gene Name: cell division cycle associated 7-like
  ENSP ID: ENSP00000411337
METLSSEESCDSFDSLESGKQDVRFHSKYFTEELRRIFIEDTDSETEDFAGFTQSDLNGKTNPEVMVVESDLSDDGKASLVSEEEEDEEEDKATPRRSRSRRSSIGLRVAFQF

SEQ ID NO: 13804 - protein, 280 aa, Homo sapiens
  Payload ID: 2676
  Gene Symbol: CDCA8
  Gene Name: cell division cycle associated 8
  Uniprot ID: Q53HL2
  ENSP ID: ENSP00000316121
MAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDEMIVEEEEEEENERKNLQTARVKRCPPSKKRTQSIQGKGKGKRSSRANTVTPAVGRLEVSMVKPTPGLTPRFDSRVFKTPGLRTPAAGERIYNISGNGSPLADSKEIFLTVPVGGGESLRLLASDLQRHSIAQLDPEALGNIKKLSNRLAQICSSIRTHK

SEQ ID NO: 13805 - protein, 280 aa, Homo sapiens; identical to SEQ ID NO: 13804
  Payload ID: 2676
  Gene Symbol: CDCA8
  Gene Name: cell division cycle associated 8
  Uniprot ID: Q53HL2
  ENSP ID: ENSP00000362146

SEQ ID NO: 13806 - protein, 301 aa, Homo sapiens
  Payload ID: 2677
  Gene Symbol: CGREF1
  Gene Name: cell growth regulator with EF-hand domain 1
  Uniprot ID: Q99674
  ENSP ID: ENSP00000260595
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEARENGEEAKELPGETLESKNTQNDFEVHIVQVENDEI

SEQ ID NO: 13807 - protein, 318 aa, Homo sapiens
  Payload ID: 2677
  Gene Symbol: CGREF1
  Gene Name: cell growth regulator with EF-hand domain 1
  Uniprot ID: Q99674
  ENSP ID: ENSP00000324025
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEAEGDAPGPRGEAGGQAEARENGEEAKELPGETLESKNTQNDFEVHIVQVENDEI

SEQ ID NO: 13808 - protein, 132 aa, Homo sapiens
  Payload ID: 2677
  Gene Symbol: CGREF1
  Gene Name: cell growth regulator with EF-hand domain 1
  Uniprot ID: Q99674
  ENSP ID: ENSP00000385103
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPGNLDARLDGGEKAMQPQW

SEQ ID NO: 13809 - protein, 318 aa, Homo sapiens; identical to SEQ ID NO: 13807
  Payload ID: 2677
  Gene Symbol: CGREF1
  Gene Name: cell growth regulator with EF-hand domain 1
  Uniprot ID: Q99674
  ENSP ID: ENSP00000385452

SEQ ID NO: 13810 - protein, 440 aa, Homo sapiens
  Payload ID: 2677
  Gene Symbol: CGREF1
  Gene Name: cell growth regulator with EF-hand domain 1
  Uniprot ID: Q99674
  ENSP ID: ENSP00000385574
MNGLKEVRYACAVLLWAPWHLVGSKGMGRGVGMRPQLCFRHSRPAFMCFIYKSWSDIYFEHSSMGSLLSVCESSLSRSPVFGAAGRSRQKMRLCLTQPICDTVADASFPRPLILFLVPVPGRMLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEAEGDAPGPRGEAGGQAEARENGEEAKELPGETLESKNTQNDFEVHIVQVENDEI

SEQ ID NO: 13811 - protein, 318 aa, Homo sapiens; identical to SEQ ID NO: 13807
  Payload ID: 2677
  Gene Symbol: CGREF1
  Gene Name: cell growth regulator with EF-hand domain 1
  Uniprot ID: Q99674
  ENSP ID: ENSP00000386113

SEQ ID NO: 13812 - protein, 57 aa, Homo sapiens
  Payload ID: 2677
  Gene Symbol: CGREF1
  Gene Name: cell growth regulator with EF-hand domain 1
  ENSP ID: ENSP00000394306
MLPLTMTVLILLLLPTGQAAPKDGVTRPDSEVQHQLLPNPFQPGQEQLGSPLPLCPP

SEQ ID NO: 13813 - protein, 332 aa, Homo sapiens
  Payload ID: 2678
  Gene Symbol: CGRRF1
  Gene Name: cell growth regulator with ring finger domain 1
  Uniprot ID: Q99675
  ENSP ID: ENSP00000216420
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 13814 - protein, 204 aa, Homo sapiens
  Payload ID: 2678
  Gene Symbol: CGRRF1
  Gene Name: cell growth regulator with ring finger domain 1
  ENSP ID: ENSP00000450430
MAAVFLVTLYEYSPLFYIAVVFTCFIVTTGLVLGWFGWDVPVILRNSEETQFSTRVFKKQMRQVKNPFGLEITNPSSASITIETVFHHVDQAGLKLLTSDDPPTSASQSAGITAGITLTTDCLEDSLLTCYWGCSVQKLYEALQKHVYCFRISTPQALEDALYSEYLYQEQYFIKKDSKEEIYCQLPRDTKIEDFGTVPRSRYP

SEQ ID NO: 13815 - protein, 44 aa, Homo sapiens
  Payload ID: 2678
  Gene Symbol: CGRRF1
  Gene Name: cell growth regulator with ring finger domain 1
  ENSP ID: ENSP00000450728
MAAVFLVTLYEYSPLFYIAVVFTCFIVTTGLVLGCWHNLDNRLP

SEQ ID NO: 13816 - protein, 91 aa, Homo sapiens
  Payload ID: 2678
  Gene Symbol: CGRRF1
  Gene Name: cell growth regulator with ring finger domain 1
  ENSP ID: ENSP00000451532
MAAVFLVTLYEYSPLFYIAVVFTCFIVTTGLVLGWFGWDVPVILRNSEETQFSTRVFKKQMRQVKNPFGLEITNPSSASITNFHGVSDSYS

SEQ ID NO: 13817 - protein, 73 aa, Homo sapiens
  Payload ID: 2678
  Gene Symbol: CGRRF1
  Gene Name: cell growth regulator with ring finger domain 1
  ENSP ID: ENSP00000470702
ISMVSVIHIPDRTYKLSCRILYQYLLLAQGQFHDLKKKKTQTEVCWKRWDSLKVKLSHRKRTARTVLFARMGL

SEQ ID NO: 13818 - protein, 1361 aa, Homo sapiens
  Payload ID: 2679
  Gene Symbol: CEMIP
  Gene Name: cell migration inducing protein, hyaluronan binding
  Uniprot ID: Q8WUJ3
  ENSP ID: ENSP00000220244
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 13819 - protein, 1361 aa, Homo sapiens; identical to SEQ ID NO: 13818
  Payload ID: 2679
  Gene Symbol: CEMIP
  Gene Name: cell migration inducing protein, hyaluronan binding
  Uniprot ID: Q8WUJ3
  ENSP ID: ENSP00000348583

SEQ ID NO: 13820 - protein, 1361 aa, Homo sapiens; identical to SEQ ID NO: 13818
  Payload ID: 2679
  Gene Symbol: CEMIP
  Gene Name: cell migration inducing protein, hyaluronan binding
  Uniprot ID: Q8WUJ3
  ENSP ID: ENSP00000378177

SEQ ID NO: 13821 - protein, 76 aa, Homo sapiens
  Payload ID: 2679
  Gene Symbol: CEMIP
  Gene Name: cell migration inducing protein, hyaluronan binding
  ENSP ID: ENSP00000431426
  MOD_RES (1)..(1): Any amino acid
XINFNKGDWIRVGLCYPRGTTFSILSDVHNRLLKQTSKTGVFVRTLQMDKVEQSYPGRSHYYWDEDSGKQRTISWR

SEQ ID NO: 13822 - protein, 145 aa, Homo sapiens
  Payload ID: 2679
  Gene Symbol: CEMIP
  Gene Name: cell migration inducing protein, hyaluronan binding
  ENSP ID: ENSP00000453066
  MOD_RES (1)..(1): Any amino acid
XRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSG

SEQ ID NO: 13823 - protein, 992 aa, Homo sapiens
  Payload ID: 2679
  Gene Symbol: CEMIP
  Gene Name: cell migration inducing protein, hyaluronan binding
  Uniprot ID: Q8WUJ3
  ENSP ID: ENSP00000480324
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDKWHSLASKAASGPSG

SEQ ID NO: 13824 - protein, 699 aa, Homo sapiens
  Payload ID: 2680
  Gene Symbol: CWH43
  Gene Name: cell wall biogenesis 43 C-terminal homolog
  Uniprot ID: Q9H720
  ENSP ID: ENSP00000226432
MPSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHHFHMNTPKYFL

SEQ ID NO: 13825 - protein, 672 aa, Homo sapiens
  Payload ID: 2680
  Gene Symbol: CWH43
  Gene Name: cell wall biogenesis 43 C-terminal homolog
  ENSP ID: ENSP00000422802
MIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHHFHMNTPKYFL

SEQ ID NO: 13826 - protein, 238 aa, Homo sapiens
  Payload ID: 2680
  Gene Symbol: CWH43
  Gene Name: cell wall biogenesis 43 C-terminal homolog
  ENSP ID: ENSP00000425157
MPSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFG

SEQ ID NO: 13827 - protein, 220 aa, Homo sapiens
  Payload ID: 2681
  Gene Symbol: CREG1
  Gene Name: cellular repressor of E1A-stimulated genes 1
  Uniprot ID: O75629
  ENSP ID: ENSP00000359540
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 13828 - protein, 290 aa, Homo sapiens
  Payload ID: 2682
  Gene Symbol: CREG2
  Gene Name: cellular repressor of E1A-stimulated genes 2
  Uniprot ID: Q8IUH2
  ENSP ID: ENSP00000315203
MSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKIQGLPFGNCLPVSDGPFNNSTGIPFFYMTAKDPVVADLMKNPMASLMLPESEGEFCRKNIVDPEDPRCVQLTLTGQMIAVSPEEVEFAKQAMFSRHPGMRKWPRQYEWFFMKMRIEHIWLQKWYGGASSISREEYFKAVPRKA

SEQ ID NO: 13829 - protein, 137 aa, Homo sapiens
  Payload ID: 2683
  Gene Symbol: CRABP1
  Gene Name: cellular retinoic acid binding protein 1
  Uniprot ID: P29762
  ENSP ID: ENSP00000299529
MPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 13830 - protein, 113 aa, Homo sapiens
  Payload ID: 2683
  Gene Symbol: CRABP1
  Gene Name: cellular retinoic acid binding protein 1
  ENSP ID: ENSP00000385978
  MOD_RES (1)..(1): Any amino acid
XDELLKALGVNAMLRKVAVAAASKPHVEIRQDGDQFYIKTSTTVRTTEINFKVGEGFEEETVDGRKCRVRPQSHYSVPVSPLGAHGPLLLEEPVSPFAACGAPSLQEFSHLGE

SEQ ID NO: 13831 - protein, 82 aa, Homo sapiens
  Payload ID: 2684
  Gene Symbol: CRABP2
  Gene Name: cellular retinoic acid binding protein 2
  ENSP ID: ENSP00000357203
MPNFSGNWKIIRSENFEELLKVLGVNVMLRKIAVAAASKPAVEIKQEGDTFYIKTSTTVRTTEINFKVGEEFEEQTVDGRPC

SEQ ID NO: 13832 - protein, 138 aa, Homo sapiens
  Payload ID: 2684
  Gene Symbol: CRABP2
  Gene Name: cellular retinoic acid binding protein 2
  Uniprot ID: P29373
  ENSP ID: ENSP00000357204
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 13833 - protein, 138 aa, Homo sapiens; identical to SEQ ID NO: 13832
  Payload ID: 2684
  Gene Symbol: CRABP2
  Gene Name: cellular retinoic acid binding protein 2
  Uniprot ID: P29373
  ENSP ID: ENSP00000357205

SEQ ID NO: 13834 - protein, 138 aa, Homo sapiens; identical to SEQ ID NO: 13832
  Payload ID: 2684
  Gene Symbol: CRABP2
  Gene Name: cellular retinoic acid binding protein 2
  Uniprot ID: P29373
  ENSP ID: ENSP00000482841

SEQ ID NO: 13835 - protein, 48 aa, Homo sapiens
  Payload ID: 2685
  Gene Symbol: CEMP1
  Gene Name: cementum protein 1
  ENSP ID: ENSP00000455479
MGTSSTDSQQAGHRRCSTSNTSAENLTCLSLPGSPGKTAPLPGPAQAG

SEQ ID NO: 13836 - protein, 247 aa, Homo sapiens
  Payload ID: 2685
  Gene Symbol: CEMP1
  Gene Name: cementum protein 1
  Uniprot ID: Q6PRD7
  ENSP ID: ENSP00000457380
MGTSSTDSQQAGHRRCSTSNTSAENLTCLSLPGSPGKTAPLPGPAQAGAGQPLPKGCAAVKAEVGIPAPHTSQEVRIHIRRLLSWAAPGACGLRSTPCALPQALPQARPCPGRWFFPGCSLPTGGAQTILSLWTWRHFLNWALQQREENSGRARRVPPVPRTAPVSKGEGSHPPQNSNGEKVKTITPDVGLHQSLTSDPTVAVLRAKRAPEAHPPRSCSGSLTARVCHMGVCQGQGDTEDGRMTLMG

SEQ ID NO: 13837 - protein, 187 aa, Homo sapiens
  Payload ID: 2686
  Gene Symbol: CENPBD1
  Gene Name: CENPB DNA-binding domains containing 1
  Uniprot ID: B2RD01
  ENSP ID: ENSP00000393854
MPGERPTDATVIPSAKRERKAITLDLKLEVLRRFEAGEKLSQIAKALDLAISTVATIRDSKEKIKASSQIATPLRASRLTRHRSAVMESMEQLLSLWLEDQSQPNATLSAAIVQEKAEFDDLQREHGEGSQTERFHASQGWLVRFKECHCLPHFKMNSAAPSNKDMYTEMLKSIIEEGEYTPQVSLT

SEQ ID NO: 13838 - protein, 685 aa, Homo sapiens
  Payload ID: 2687
  Gene Symbol: CTGLF11P
  Gene Name: centaurin, gamma-like family, member 11 pseudogene
  ENSP ID: ENSP00000485140
MGNILTCRVHPSVSLEFDQQQGSVCPSESEIYEAGAEDRMAGAPMAAAVQPAEVTVEVGEDLHMHHVRDREMPEALEFNLSANPEASTILQRNSQTDALEFNPSANPEASTIFQRNSQTDVVEIRRSNCTNHVSTERFSQQYSSCSTIFLDDSTASQHYLTMTIISVTLEIPHHITQRDADRSLSIPDEQLSFAVSTVHITKNRNGGGSLNNYSSSIPSTPSTSQEDPQFSVPPTANTPTPVCKRSMCWSNLFTSEKGSHPDKERKAPENHADTIGSSRAIPIKQGMLLKRSGKWLKTWKKKYVTLCSNGVLTYYSSLGDYMKNIHKKEIDLRTSTIKVPGKWPSLATSASAPISSSKSNGLSKDMDTGLGDSICFSPSISSTTSPKLNLPPSPHANKKKHLKKKSTNNFMIVSATGQTWHFEATTYEERDAWVQAIQSQIVASLQSCESSKSKSQLTSQSEAMALQSIQNMRGNAHCVDCETQNPKWASLNLGVLMCIECSGIHCSLGTRLSRVRSLELDDWPVELRKVMSSIGNDLANSIWEGSSQGQTKPSVKSTREEKERWIRSKYEKKLFLAPLPCTELSLGQHLLRATADEDLQTAILLLAHGSREEVNETCGEGDGCTALHLACRKGNVVLAQLLIWYRVDVMARDAHGNTALTYARQASSQECINVLLQYGCPDECV

SEQ ID NO: 13839 - protein, 391 aa, Homo sapiens
  Payload ID: 2688
  Gene Symbol: CNTLN
  Gene Name: centlein, centrosomal protein
  Uniprot ID: Q9NXG0
  ENSP ID: ENSP00000370015
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKVCFYSVIKM

SEQ ID NO: 13840 - protein, 1406 aa, Homo sapiens
  Payload ID: 2688
  Gene Symbol: CNTLN
  Gene Name: centlein, centrosomal protein
  Uniprot ID: Q9NXG0
  ENSP ID: ENSP00000370021
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 13841 - protein, 172 aa, Homo sapiens
  Payload ID: 2689
  Gene Symbol: CETN1
  Gene Name: centrin, EF-hand protein, 1
  Uniprot ID: Q12798
  ENSP ID: ENSP00000319052
MASGFKKPSAASTGQKRKVAPKPELTEDQKQEVREAFDLFDVDGSGTIDAKELKVAMRALGFEPRKEEMKKMISEVDREGTGKISFNDFLAVMTQKMSEKDTKEEILKAFRLFDDDETGKISFKNLKRVANELGENLTDEELQEMIDEADRDGDGEVNEEEFLRIMKKTSLY

SEQ ID NO: 13842 - protein, 172 aa, Homo sapiens
  Payload ID: 2690
  Gene Symbol: CETN2
  Gene Name: centrin, EF-hand protein, 2
  Uniprot ID: P41208
  ENSP ID: ENSP00000359300
MASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 13843 - protein, 167 aa, Homo sapiens
  Payload ID: 2691
  Gene Symbol: CETN3
  Gene Name: centrin, EF-hand protein, 3
  Uniprot ID: O15182
  ENSP ID: ENSP00000283122
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGEINQEEFIAIMTGDI

SEQ ID NO: 13844 - protein, 191 aa, Homo sapiens
  Payload ID: 2691
  Gene Symbol: CETN3
  Gene Name: centrin, EF-hand protein, 3
  ENSP ID: ENSP00000428259
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGEILKNILLLPIWSRCLSLNREFFSEVNQEEFIAIMTGDI

SEQ ID NO: 13845 - protein, 81 aa, Homo sapiens
  Payload ID: 2691
  Gene Symbol: CETN3
  Gene Name: centrin, EF-hand protein, 3
  ENSP ID: ENSP00000429772
ELVVDKTKRKKRRELSEEQKQEIKDAFELFDTDKDEAIDYHELKVAMRALGFDVKKADVLKILKDYDREATGKITFEDFNE

SEQ ID NO: 13846 - protein, 111 aa, Homo sapiens
  Payload ID: 2691
  Gene Symbol: CETN3
  Gene Name: centrin, EF-hand protein, 3
  ENSP ID: ENSP00000429875
MSLALRSELVVDKTKRKKRRELSEEQKQEIKDAFELFDTDKDEAIDYHELKVAMRALGFDVKKADVLKILKDYDREATGKITFEDFNEVGVYFNSLCNQQLLGNCLINITF

SEQ ID NO: 13847 - protein, 153 aa, Homo sapiens
  Payload ID: 2691
  Gene Symbol: CETN3
  Gene Name: centrin, EF-hand protein, 3
  ENSP ID: ENSP00000430361
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSVLKNILLLPIWSRCLSLNREFFSEVNQEEFIAIMTGDI

SEQ ID NO: 13848 - protein, 156 aa, Homo sapiens
  Payload ID: 2691
  Gene Symbol: CETN3
  Gene Name: centrin, EF-hand protein, 3
  ENSP ID: ENSP00000430409
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGESKF

SEQ ID NO: 13849 - protein, 1012 aa, Homo sapiens
  Payload ID: 2692
  Gene Symbol: CCP110
  Gene Name: centriolar coiled coil protein 110kDa
  Uniprot ID: O43303
  ENSP ID: ENSP00000370803
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSINRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGTPKTSVKGVVQNRQKPSQSRVPNRVPVSGVYAGKIQRKRPNVATI

SEQ ID NO: 13850 - protein, 991 aa, Homo sapiens
  Payload ID: 2692
  Gene Symbol: CCP110
  Gene Name: centriolar coiled coil protein 110kDa
  Uniprot ID: O43303
  ENSP ID: ENSP00000379511
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSINRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGSICRKNPKKAAKCCDNLRRQHSLG

SEQ ID NO: 13851 - protein, 991 aa, Homo sapiens; identical to SEQ ID NO: 13850
  Payload ID: 2692
  Gene Symbol: CCP110
  Gene Name: centriolar coiled coil protein 110kDa
  Uniprot ID: O43303
  ENSP ID: ENSP00000379515

SEQ ID NO: 13852 - protein, 50 aa, Homo sapiens
  Payload ID: 2692
  Gene Symbol: CCP110
  Gene Name: centriolar coiled coil protein 110kDa
  ENSP ID: ENSP00000454514
MEEYEKFCEKSLARIQEASLSTESFLPAQSESISLIRFHGVAILSPLVNL

SEQ ID NO: 13853 - protein, 52 aa, Homo sapiens
  Payload ID: 2692
  Gene Symbol: CCP110
  Gene Name: centriolar coiled coil protein 110kDa
  ENSP ID: ENSP00000458123
MEEYEKFCEKSLARIQEASLSTESFLPAQSESISLIRFHGVAILSPLKARSY

SEQ ID NO: 13854 - protein, 120 aa, Homo sapiens
  Payload ID: 2692
  Gene Symbol: CCP110
  Gene Name: centriolar coiled coil protein 110kDa
  ENSP ID: ENSP00000459410
RIQEASLSTESFLPAQSESISLIRFHGVAILSPLVRKAPNASDFDQWEMETVYSNSEVRNLNVPATFPNSFPSHTEHSTAAKLDKIAGILPLDNEDQCKTDGIDLARDSEGFNSPKQCDS

SEQ ID NO: 13855 - protein, 270 aa, Homo sapiens
  Payload ID: 2693
  Gene Symbol: CCSAP
  Gene Name: centriole, cilia and spindle-associated protein
  Uniprot ID: Q6IQ19
  ENSP ID: ENSP00000284617
MSPGSGVKSEYMKRYQEPRWEEYGPCYRELLHYRLGRRLLEQAHAPWLWDDWGPAGSSEDSASSESSGAGGPAPRCAPPSPPPPVEPATQEEAERRARGAPEEQDAEAGDAEAEDAEDAALPALPVKDVEDKPEQQTRTRETDKSPTSTEPRQQPSALFARGNRKAVKSPQRSSSKIKENKHPFALYGWGEKQTDTGSQKTHNVCASAPVHEIHESALRAKNRRQVEKRKLVAQRQRAHSVDVEKNRKMKASSSENPWMTEYMRCYSARA

SEQ ID NO: 13856 - protein, 156 aa, Homo sapiens
  Payload ID: 2693
  Gene Symbol: CCSAP
  Gene Name: centriole, cilia and spindle-associated protein
  Uniprot ID: Q6IQ19
  ENSP ID: ENSP00000355647
MVPVFTSSALPVKDVEDKPEQQTRTRETDKSPTSTEPRQQPSALFARGNRKAVKSPQRSSSKIKENKHPFALYGWGEKQTDTGSQKTHNVCASAPVHEIHESALRAKNRRQVEKRKLVAQRQRAHSVDVEKNRKMKASSSENPWMTEYMRCYSARA

SEQ ID NO: 13857 - protein, 270 aa, Homo sapiens; identical to SEQ ID NO: 13855
  Payload ID: 2693
  Gene Symbol: CCSAP
  Gene Name: centriole, cilia and spindle-associated protein
  Uniprot ID: Q6IQ19
  ENSP ID: ENSP00000355648

SEQ ID NO: 13858 - protein, 2325 aa, Homo sapiens
  Payload ID: 2694
  Gene Symbol: CNTRL
  Gene Name: centriolin
  Uniprot ID: Q7Z7A1
  ENSP ID: ENSP00000238341
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKKISAAQTRLSELHDEIEKAEQQILRATEEFKQLEEAIQLKKISEAGKDLLYKQLSGRLQLVNKLRQEALDLELQMEKQKQEIAGKQKEIKDLQIAIDSLDSKDPKHSHMKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 13859 - protein, 145 aa, Homo sapiens
  Payload ID: 2694
  Gene Symbol: CNTRL
  Gene Name: centriolin
  ENSP ID: ENSP00000362950
MAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTAFLQ

SEQ ID NO: 13860 - protein, 994 aa, Homo sapiens
  Payload ID: 2694
  Gene Symbol: CNTRL
  Gene Name: centriolin
  ENSP ID: ENSP00000362953
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEE

SEQ ID NO: 13861 - protein, 1773 aa, Homo sapiens
  Payload ID: 2694
  Gene Symbol: CNTRL
  Gene Name: centriolin
  Uniprot ID: Q7Z7A1
  ENSP ID: ENSP00000362956
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 13862 - protein, 2325 aa, Homo sapiens; identical to SEQ ID NO: 13858
  Payload ID: 2694
  Gene Symbol: CNTRL
  Gene Name: centriolin
  Uniprot ID: Q7Z7A1
  ENSP ID: ENSP00000362962

SEQ ID NO: 13863 - protein, 460 aa, Homo sapiens
  Payload ID: 2694
  Gene Symbol: CNTRL
  Gene Name: centriolin
  ENSP ID: ENSP00000362972
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKKISAAQTRLSELHDEI

SEQ ID NO: 13864 - protein, 346 aa, Homo sapiens
  Payload ID: 2694
  Gene Symbol: CNTRL
  Gene Name: centriolin
  ENSP ID: ENSP00000413014
MQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEI

SEQ ID NO: 13865 - protein, 482 aa, Homo sapiens
  Payload ID: 2694
  Gene Symbol: CNTRL
  Gene Name: centriolin
  Uniprot ID: Q7Z7A1
  ENSP ID: ENSP00000481072
MEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 13866 - protein, 925 aa, Homo sapiens
  Payload ID: 2695
  Gene Symbol: CNTROB
  Gene Name: centrobin, centrosomal BRCA2 interacting protein
  Uniprot ID: Q8N137
  ENSP ID: ENSP00000369614
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGYKPGRKEEGFSGWKLDYGEWSGTDGRGDNVPRRNTDSRLGEIPRKEIPSQAVPRRLATAPKTEKPPARKKSGHPAPSSMRSRGGVWR

SEQ ID NO: 13867 - protein, 904 aa, Homo sapiens
  Payload ID: 2695
  Gene Symbol: CNTROB
  Gene Name: centrobin, centrosomal BRCA2 interacting protein
  Uniprot ID: Q8N137
  ENSP ID: ENSP00000454840
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGRTDGRGDNVPRRNTDSRLGEIPRKEIPSQAVPRRLATAPKTEKPPARKKSGHPAPSSMRSRGGVWR

SEQ ID NO: 13868 - protein, 903 aa, Homo sapiens
  Payload ID: 2695
  Gene Symbol: CNTROB
  Gene Name: centrobin, centrosomal BRCA2 interacting protein
  Uniprot ID: Q8N137
  ENSP ID: ENSP00000456335
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLGEIPRKEIPSQAVPRRLATAPKTEKPPARKKSGHPAPSSMRSRGGVWR

SEQ ID NO: 13869 - protein, 187 aa, Homo sapiens
  Payload ID: 2695
  Gene Symbol: CNTROB
  Gene Name: centrobin, centrosomal BRCA2 interacting protein
  ENSP ID: ENSP00000458251
PFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGTDGRGDNVPRRNTDSRLDSLPGCPSPPCYSP

SEQ ID NO: 13870 - protein, 242 aa, Homo sapiens
  Payload ID: 2695
  Gene Symbol: CNTROB
  Gene Name: centrobin, centrosomal BRCA2 interacting protein
  ENSP ID: ENSP00000458688
  MOD_RES (1)..(1): Any amino acid
XAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKTYSVLGTQASWLQPTPPLEELESLVLWSYQRWATPRLLTLFPSIVSAIFRACRPEC

SEQ ID NO: 13871 - protein, 199 aa, Homo sapiens
  Payload ID: 2695
  Gene Symbol: CNTROB
  Gene Name: centrobin, centrosomal BRCA2 interacting protein
  ENSP ID: ENSP00000458696
MESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQE

SEQ ID NO: 13872 - protein, 26 aa, Homo sapiens
  Payload ID: 2695
  Gene Symbol: CNTROB
  Gene Name: centrobin, centrosomal BRCA2 interacting protein
  ENSP ID: ENSP00000458787
  MOD_RES (1)..(1): Any amino acid
XTATLLKISQLDKWIPKAFPALTFST

SEQ ID NO: 13873 - protein, 198 aa, Homo sapiens
  Payload ID: 2695
  Gene Symbol: CNTROB
  Gene Name: centrobin, centrosomal BRCA2 interacting protein
  ENSP ID: ENSP00000459246
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRK

SEQ ID NO: 13874 - protein, 13 aa, Homo sapiens
  Payload ID: 2695
  Gene Symbol: CNTROB
  Gene Name: centrobin, centrosomal BRCA2 interacting protein
  ENSP ID: ENSP00000460583
MATSADSPSSPLG

SEQ ID NO: 13875 - protein, 77 aa, Homo sapiens
  Payload ID: 2695
  Gene Symbol: CNTROB
  Gene Name: centrobin, centrosomal BRCA2 interacting protein
  ENSP ID: ENSP00000461000
MATSADSPSSPLGAEDLLSDSSEPPGLNQVSSEVTSQLYASLRLSRQAEATARAQLYLPSTSPPHEGLDGFAQELSR

SEQ ID NO: 13876 - protein, 114 aa, Homo sapiens
  Payload ID: 2696
  Gene Symbol: CENPA
  Gene Name: centromere protein A
  Uniprot ID: P49450
  ENSP ID: ENSP00000233505
MGPRRRSRKPEAPRRRSPSPTPTPGPSRRGPSLGASSHQHSRRRQGWLKEIRKLQKSTHLLIRKLPFSRLAAEAFLVHLFEDAYLLTLHAGRVTLFPKDVQLARRIRGLEEGLG

SEQ ID NO: 13877 - protein, 140 aa, Homo sapiens
  Payload ID: 2696
  Gene Symbol: CENPA
  Gene Name: centromere protein A
  Uniprot ID: P49450
  ENSP ID: ENSP00000336868
MGPRRRSRKPEAPRRRSPSPTPTPGPSRRGPSLGASSHQHSRRRQGWLKEIRKLQKSTHLLIRKLPFSRLAREICVKFTRGVDFNWQAQALLALQEAAEAFLVHLFEDAYLLTLHAGRVTLFPKDVQLARRIRGLEEGLG

SEQ ID NO: 13878 - protein, 86 aa, Homo sapiens
  Payload ID: 2696
  Gene Symbol: CENPA
  Gene Name: centromere protein A
  ENSP ID: ENSP00000404963
MGPRRRSRKPEAPRRRSPSPTPTPGPSRRGPSLGASSHQHSRRRQGWLKEIRKLQKSTHLLIRKLPFSRLIPFPILGDCLSSPNYW

SEQ ID NO: 13879 - protein, 599 aa, Homo sapiens
  Payload ID: 2697
  Gene Symbol: CENPB
  Gene Name: centromere protein B, 80kDa
  Uniprot ID: P07199
  ENSP ID: ENSP00000369075
MGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 13880 - protein, 943 aa, Homo sapiens
  Payload ID: 2698
  Gene Symbol: CENPC
  Gene Name: centromere protein C
  Uniprot ID: Q03188
  ENSP ID: ENSP00000273853
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALLQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 13881 - protein, 728 aa, Homo sapiens
  Payload ID: 2698
  Gene Symbol: CENPC
  Gene Name: centromere protein C
  ENSP ID: ENSP00000421234
EASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALLQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERSMNLFLKVTFRFYFK

SEQ ID NO: 13882 - protein, 107 aa, Homo sapiens
  Payload ID: 2698
  Gene Symbol: CENPC
  Gene Name: centromere protein C
  ENSP ID: ENSP00000425255
QSKVIPKNRIHHKLVLPSNTPNVRRTKRTRLKPLEYWRGERIDYQGRPSGGFVISGVLSPDTISSKRKAKENIGKVNKKSNKKRICLDNDERSMNLFLKVTFRFYFK

SEQ ID NO: 13883 - protein, 542 aa, Homo sapiens
  Payload ID: 2698
  Gene Symbol: CENPC
  Gene Name: centromere protein C
  Uniprot ID: Q03188
  ENSP ID: ENSP00000426078
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAQKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALLQGRKSREKHHNILPKTLANDKHSHKPHPVETSQPSDKTVLDTSYALIGETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESCLKC

SEQ ID NO: 13884 - protein, 2701 aa, Homo sapiens
  Payload ID: 2699
  Gene Symbol: CENPE
  Gene Name: centromere protein E, 312kDa
  Uniprot ID: Q02224
  ENSP ID: ENSP00000265148
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEAQNLSMQSVRMDNFQLTKKLHESLEEIRIVAKERDELRRIKESLKMERDQFIATLREMIARDRQNHQVKPEKRLLSDGQQHLTESLREKCSRIKELLKRYSEMDDHYECLNRLSLDLEKEIEFQKELSMRVKANLSLPYLQTKHIEKLFTANQRCSMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 13885 - protein, 2580 aa, Homo sapiens
  Payload ID: 2699
  Gene Symbol: CENPE
  Gene Name: centromere protein E, 312kDa
  Uniprot ID: Q02224
  ENSP ID: ENSP00000369365
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKQDRQNHQVKPEKRLLSDGQQHLTESLREKCSRIKELLKRYSEMDDHYECLNRLSLDLEKEIEFQKELSMRVKANLSLPYLQTKHIEKLFTANQRCSMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 13886 - protein, 1126 aa, Homo sapiens
  Payload ID: 2699
  Gene Symbol: CENPE
  Gene Name: centromere protein E, 312kDa
  ENSP ID: ENSP00000423981
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVE

SEQ ID NO: 13887 - protein, 183 aa, Homo sapiens
  Payload ID: 2699
  Gene Symbol: CENPE
  Gene Name: centromere protein E, 312kDa
  ENSP ID: ENSP00000426023
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKRNVYVADLTEEVVYTSEMALKWITKGEKSRHYGETKMNQRSSRSHTIFRMILESREKGEPSNCE

SEQ ID NO: 13888 - protein, 2664 aa, Homo sapiens
  Payload ID: 2699
  Gene Symbol: CENPE
  Gene Name: centromere protein E, 312kDa
  ENSP ID: ENSP00000483542
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEAQNYLCKCEMDNFQLTKKLHESLEEIRIVAKERDELRRIKESLKMERDQFIATLREMIARDRQNHQVKPEKRLLSDGQQHLTESLREKCSRIKELLKRYSEMDDHYECLNRLSLDLEKEMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 13889 - protein, 3114 aa, Homo sapiens
  Payload ID: 2700
  Gene Symbol: CENPF
  Gene Name: centromere protein F, 350/400kDa
  Uniprot ID: P49454
  ENSP ID: ENSP00000355922
MSWALEEWKEGLPTRALQKIQELEGQLDKLKKEKQQRQFQLDSLEAALQKQKQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGEQEVTPSRSTLQIGKRDANSSFFDNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKINQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKENLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGRGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESNGSENCKVQ

SEQ ID NO: 13890 - protein, 175 aa, Homo sapiens
  Payload ID: 2700
  Gene Symbol: CENPF
  Gene Name: centromere protein F, 350/400kDa
  ENSP ID: ENSP00000478221
LMIKGRKGKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKEQ

SEQ ID NO: 13891 - protein, 247 aa, Homo sapiens
  Payload ID: 2701
  Gene Symbol: CENPH
  Gene Name: centromere protein H
  Uniprot ID: Q9H3R5
  ENSP ID: ENSP00000283006
MEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 13892 - protein, 98 aa, Homo sapiens
  Payload ID: 2701
  Gene Symbol: CENPH
  Gene Name: centromere protein H
  ENSP ID: ENSP00000422665
MEEQPQMQDADEPADSGGEGRAGGPPQVAGAQAACSEDRMTLLLRLRAQTKQQLLEYKSMVDASEEKTPEQIMQEKQIEAKIEDLENEIEEDETFNCT

SEQ ID NO: 13893 - protein, 187 aa, Homo sapiens
  Payload ID: 2701
  Gene Symbol: CENPH
  Gene Name: centromere protein H
  ENSP ID: ENSP00000423936
  MOD_RES (1)..(1): Any amino acid
XEDRMTLLLRLRAQTKQQLLEYKSMVDASEEKTPEQIMQEKQIEAMRLSTALKKNLEKISRQSSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 13894 - protein, 228 aa, Homo sapiens
  Payload ID: 2701
  Gene Symbol: CENPH
  Gene Name: centromere protein H
  ENSP ID: ENSP00000426014
MEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 13895 - protein, 522 aa, Homo sapiens
  Payload ID: 2702
  Gene Symbol: CENPI
  Gene Name: centromere protein I
  Uniprot ID: Q92674
  ENSP ID: ENSP00000362017
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPL

SEQ ID NO: 13896 - protein, 756 aa, Homo sapiens
  Payload ID: 2702
  Gene Symbol: CENPI
  Gene Name: centromere protein I
  Uniprot ID: Q92674
  ENSP ID: ENSP00000362018
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPLETTLGGSMNSVSKLIHYVGWLSTTAMRLESNNTFLLHFILDFYEKVCDIYINYNLPLVVLFPPGIFYSALLSLDTSILNQLCFIMHRYRKNLTAAKKNELVQKTKSEFNFSSKTYQEFNHYLTSMVGCLWTSKPFGKGIYIDPEILEKTGVAEYKNSLNVVHHPSFLSYAVSFLLQESPEERTVNVSSIRGKKWSWYLDYLFSQGLQGLKLFIRSSVHHSSIPRAEGINCNNQY

SEQ ID NO: 13897 - protein, 75 aa, Homo sapiens
  Payload ID: 2702
  Gene Symbol: CENPI
  Gene Name: centromere protein I
  ENSP ID: ENSP00000384546
MSPQKRVKNVQAQNRTSQGSSSFQTTLSAWKVKQDPSNSKNISKHGQNNPVGDYEHADDQAEEDALQMAVGYFEK

SEQ ID NO: 13898 - protein, 756 aa, Homo sapiens; identical to SEQ ID NO: 13896
  Payload ID: 2702
  Gene Symbol: CENPI
  Gene Name: centromere protein I
  Uniprot ID: Q92674
  ENSP ID: ENSP00000399274

SEQ ID NO: 13899 - protein, 45 aa, Homo sapiens
  Payload ID: 2702
  Gene Symbol: CENPI
  Gene Name: centromere protein I
  ENSP ID: ENSP00000409173
MSPQKRVKNVQAQNRTSQGSSSFQTTLSAWKVKQDPSNSKNISKH

SEQ ID NO: 13900 - protein, 1338 aa, Homo sapiens
  Payload ID: 2703
  Gene Symbol: CENPJ
  Gene Name: centromere protein J
  Uniprot ID: Q9HC77
  ENSP ID: ENSP00000371308
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGNPPRRSKSAPPRDLGNLDKGQAASPREPLEPLNFPDPEYKEEEEDQDIQGEISHPDGKVEKVYKNGCRVILFPNGTRKEVSADGKTITVTFFNGDVKQVMPDQRVIYYYAAAQTTHTTYPEGLEVLHFSSGQIEKHYPDGRKEITFPDQTVKNLFPDGQEESIFPDGTIVRVQRDGNKLIEFNNGQRELHTAQFKRREYPDGTVKTVYANGHQETKYRSGRIRVKDKEGNVLMDTEL

SEQ ID NO: 13901 - protein, 196 aa, Homo sapiens
  Payload ID: 2703
  Gene Symbol: CENPJ
  Gene Name: centromere protein J
  ENSP ID: ENSP00000399334
  MOD_RES (1)..(1): Any amino acid
XFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGKRLHDLFIKHFRM

SEQ ID NO: 13902 - protein, 1136 aa, Homo sapiens
  Payload ID: 2703
  Gene Symbol: CENPJ
  Gene Name: centromere protein J
  ENSP ID: ENSP00000441090
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLANTSVRFQNSQISSGTQVEKYKKNYLPMQGTAQPPHTPSSLLADHLPPLSSFRPFSRNIQLCYTF

SEQ ID NO: 13903 - protein, 1086 aa, Homo sapiens
  Payload ID: 2703
  Gene Symbol: CENPJ
  Gene Name: centromere protein J
  Uniprot ID: Q9HC77
  ENSP ID: ENSP00000477511
MFLMPTSSELNSGQNFLTQWMTNPSRAGVILNRGFPILEADKEKRAAVDISTSFPIKGTHFSDSFSFINEEDSLLEEQKLESNNPYKPQSDKSETHTAFPCIKKGPQVAACHSAPGHQEENKNDFIPDLASEFKEGAYKDPLFKKLEQLKEVQQKKQEQLKRQQLEQLQRLMEEQEKLLTMVSGQCTLPGLSLLPDDQSQKHRSPGNTTTGERATCCFPSYVYPDPTQEETYPSNILSHEQSNFCRTAHGDFVLTSKRASPNLFSEAQYQEAPVEKNNLKEENRNHPTGESILCWEKVTEQIQEANDKNLQKHDDSSEVANIEERPIKAAIGERKQTFEDYLEEQIQLEEQELKQKQLKEAEGPLPIKAKPKQPFLKRGEGLARFTNAKSKFQKGKESKLVTNQSTSEDQPLFKMDRQQLQRKTALKNKELCADNPILKKDSKARTKSGSVTLSQKPKMLKCSNRKSLSPSGLKIQTGKKCDGQFRDQIKFENKVTSNNKENVTECPKPCDTGCTGWNKTQGKDRLPLSTGPASRLAAKSPIRETMKESESSLDVSLQKKLETWEREKEKENLELDEFLFLEQAADEISFSSNSSFVLKILERDQQICKGHRMSSTPVKAVPQKTNPADPISHCNRSEDLDHTAREKESECEVAPKQLHSLSSADELREQPCKIRKAVQKSTSENQTEWNARDDEGVPNSDSSTDSEEQLDVTIKPSTEDRERGISSREDSPQVCDDKGPFKDTRTQEDKRRDVDLDLSDKDYSSDESIMESIKHKVSEPSRSSSLSLSKMDFDDERTWTDLEENLCNHDVVLGNESTYGTPQTCYPNNEIGILDKTIKRKIAPVKRGEDLSKSRRSRSPPTSELMMKFFPSLKPKPKSDSHLGNELKLNISQDQPPGDNARSQVLREKIIELETEIEKFKAENASLAKLRIERESALEKLRKEIADFEQQKAKELARIEEFKKEEMRKLQKERKVFEKYTTAARTFPDKKEREEIQTLKQQIADLREDLKRKETKWSSTHSRLRSQIQMLVRENTDLREEIKVMERFRLDAWKRAEAIESSLEVEKKDKLAAIHLEDPSLHLLVI

SEQ ID NO: 13904 - protein, 269 aa, Homo sapiens
  Payload ID: 2704
  Gene Symbol: CENPK
  Gene Name: centromere protein K
  Uniprot ID: Q9BS16
  ENSP ID: ENSP00000242872
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 13905 - protein, 269 aa, Homo sapiens; identical to SEQ ID NO: 13904
  Payload ID: 2704
  Gene Symbol: CENPK
  Gene Name: centromere protein K
  Uniprot ID: Q9BS16
  ENSP ID: ENSP00000379911

SEQ ID NO: 13906 - protein, 239 aa, Homo sapiens
  Payload ID: 2704
  Gene Symbol: CENPK
  Gene Name: centromere protein K
  ENSP ID: ENSP00000421034
MWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 13907 - protein, 176 aa, Homo sapiens
  Payload ID: 2704
  Gene Symbol: CENPK
  Gene Name: centromere protein K
  ENSP ID: ENSP00000422365
MTLFQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKE

SEQ ID NO: 13908 - protein, 269 aa, Homo sapiens; identical to SEQ ID NO: 13904
  Payload ID: 2704
  Gene Symbol: CENPK
  Gene Name: centromere protein K
  Uniprot ID: Q9BS16
  ENSP ID: ENSP00000422421

SEQ ID NO: 13909 - protein, 106 aa, Homo sapiens
  Payload ID: 2704
  Gene Symbol: CENPK
  Gene Name: centromere protein K
  ENSP ID: ENSP00000423308
MNQEDLDPDSTTDVGDVTNTEEELIRECEEMWKDMEECQNKLSLIGTETLTDSNAQLSLLIMQVKCLTAELSQWQKKTPERSHRVVQAGVQWHNHGSLQPRSPGFK

SEQ ID NO: 13910 - protein, 117 aa, Homo sapiens
  Payload ID: 2704
  Gene Symbol: CENPK
  Gene Name: centromere protein K
  ENSP ID: ENSP00000424039
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEILQMMILSYKPVGCPLNSLQF

SEQ ID NO: 13911 - protein, 24 aa, Homo sapiens
  Payload ID: 2704
  Gene Symbol: CENPK
  Gene Name: centromere protein K
  ENSP ID: ENSP00000424450
  MOD_RES (1)..(1): Any amino acid
XRVVQAGVQWHNHGSLQPRSPGFK

SEQ ID NO: 13912 - protein, 132 aa, Homo sapiens
  Payload ID: 2704
  Gene Symbol: CENPK
  Gene Name: centromere protein K
  ENSP ID: ENSP00000424686
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQ

SEQ ID NO: 13913 - protein, 206 aa, Homo sapiens
  Payload ID: 2704
  Gene Symbol: CENPK
  Gene Name: centromere protein K
  ENSP ID: ENSP00000425686
MWKDMEECQNKLSLIGTETLTDSNAQLSLLIMQVKCLTAELSQWQKKTPETIPLTEDVLITLGKEEFQKLRQDLEMVLSTKESKNEKLKEDLERIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 13914 - protein, 106 aa, Homo sapiens; identical to SEQ ID NO: 13909
  Payload ID: 2704
  Gene Symbol: CENPK
  Gene Name: centromere protein K
  ENSP ID: ENSP00000427648

SEQ ID NO: 13915 - protein, 344 aa, Homo sapiens
  Payload ID: 2705
  Gene Symbol: CENPL
  Gene Name: centromere protein L
  Uniprot ID: Q8N0S6
  ENSP ID: ENSP00000323543
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQIVSKSQLPSENREGKVLWTGWFCCVFGDSLLETVSEDFTCLPLFLANGAESNTAIIGTWFQKTFDCYFSPLAINAFNLSWMAAMWTACKMDHYVATTEFLWSVPCSPQSLDISFAIHPEDAKALWDSVHKTPGEVTQEEVDLFMDCLYSHFHRHFKIHLSATRLVRVSTSVASAHTDGKIKILCHKYLIGVLAYLTELAIFQIE

SEQ ID NO: 13916 - protein, 390 aa, Homo sapiens
  Payload ID: 2705
  Gene Symbol: CENPL
  Gene Name: centromere protein L
  Uniprot ID: Q8N0S6
  ENSP ID: ENSP00000348527
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQGLILSPRLEYSGTILVDCNLCLLGSSDPSTLAFQVAGTAGACHHTRIVSKSQLPSENREGKVLWTGWFCCVFGDSLLETVSEDFTCLPLFLANGAESNTAIIGTWFQKTFDCYFSPLAINAFNLSWMAAMWTACKMDHYVATTEFLWSVPCSPQSLDISFAIHPEDAKALWDSVHKTPGEVTQEEVDLFMDCLYSHFHRHFKIHLSATRLVRVSTSVASAHTDGKIKILCHKYLIGVLAYLTELAIFQIE

SEQ ID NO: 13917 - protein, 344 aa, Homo sapiens; identical to SEQ ID NO: 13915
  Payload ID: 2705
  Gene Symbol: CENPL
  Gene Name: centromere protein L
  Uniprot ID: Q8N0S6
  ENSP ID: ENSP00000356683

SEQ ID NO: 13918 - protein, 180 aa, Homo sapiens
  Payload ID: 2706
  Gene Symbol: CENPM
  Gene Name: centromere protein M
  Uniprot ID: Q9NSP4
  ENSP ID: ENSP00000215980
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 13919 - protein, 125 aa, Homo sapiens
  Payload ID: 2706
  Gene Symbol: CENPM
  Gene Name: centromere protein M
  ENSP ID: ENSP00000384132
MLKEDCASELKVHLAKSLPLPSSVNRPRIDLIVFVVNLHSKYRIREARTSAFSVVKFCSLVCFLTLAWPPQSPEHRGVPAPCGCQLLLGEGVFPRHRCWAGEPLQHSPAHRGEAGPHLSKPPALL

SEQ ID NO: 13920 - protein, 146 aa, Homo sapiens
  Payload ID: 2706
  Gene Symbol: CENPM
  Gene Name: centromere protein M
  ENSP ID: ENSP00000384731
MLKEDCASELKVHLAKSLPLPSSVNRPRIDLIVFVVNLHSKYSLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 13921 - protein, 107 aa, Homo sapiens
  Payload ID: 2706
  Gene Symbol: CENPM
  Gene Name: centromere protein M
  Uniprot ID: Q9NSP4
  ENSP ID: ENSP00000384743
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGGGRL

SEQ ID NO: 13922 - protein, 73 aa, Homo sapiens
  Payload ID: 2706
  Gene Symbol: CENPM
  Gene Name: centromere protein M
  ENSP ID: ENSP00000384814
MLKEDCASELKVHLAKSLPLPSSVNRPRIDLIVFVVNLHSKYSLQNTEESLRHVDASFFLGKVCFLATGGGRL

SEQ ID NO: 13923 - protein, 58 aa, Homo sapiens
  Payload ID: 2706
  Gene Symbol: CENPM
  Gene Name: centromere protein M
  Uniprot ID: Q9NSP4
  ENSP ID: ENSP00000430624
MGRVWDLPGVLKVEGFRATMAQRLVRVLQICAGHVPGVSALNLLSLLRSSEGPSLEDL

SEQ ID NO: 13924 - protein, 204 aa, Homo sapiens
  Payload ID: 2707
  Gene Symbol: CENPN
  Gene Name: centromere protein N
  Uniprot ID: Q96H22
  ENSP ID: ENSP00000299572
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQELEATGKIYLRQEEIILDITEMKKACN

SEQ ID NO: 13925 - protein, 339 aa, Homo sapiens
  Payload ID: 2707
  Gene Symbol: CENPN
  Gene Name: centromere protein N
  Uniprot ID: Q96H22
  ENSP ID: ENSP00000305608
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAGIADAPLSPLLTCIPNKRMNYFKIRDK

SEQ ID NO: 13926 - protein, 353 aa, Homo sapiens
  Payload ID: 2707
  Gene Symbol: CENPN
  Gene Name: centromere protein N
  Uniprot ID: Q96H22
  ENSP ID: ENSP00000377007
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAALVCRIQKLLCYSGSHSQGTQDPSSWQKDLYLLFVPLYPRC

SEQ ID NO: 13927 - protein, 305 aa, Homo sapiens
  Payload ID: 2707
  Gene Symbol: CENPN
  Gene Name: centromere protein N
  Uniprot ID: Q96H22
  ENSP ID: ENSP00000393991
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAGIADAPLSPLLTCIPNKRMNYFKIRDK

SEQ ID NO: 13928 - protein, 319 aa, Homo sapiens
  Payload ID: 2707
  Gene Symbol: CENPN
  Gene Name: centromere protein N
  Uniprot ID: Q96H22
  ENSP ID: ENSP00000395235
MDETVAEFIKRTILKIPMNELTTILKAWDFLSENQLQTVNFRQRKESVVQHLIHLCEEKRASISDAALLDIICEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSRYLDSLKAIVFKQYNQTFETHNSTTPLQERSLGLDINMDSRIIHENIVEKERVQRITQETFGDYPQPQLEFAQYKLETKFKSGLNGSILAEREEPLRCLIKFSSPHLLEALKSLAPAGIADAPLSPLLTCIPNKRMNYFKIRDK

SEQ ID NO: 13929 - protein, 177 aa, Homo sapiens
  Payload ID: 2707
  Gene Symbol: CENPN
  Gene Name: centromere protein N
  ENSP ID: ENSP00000454327
MDETVAEFIKRTILKIPMNELTTILKAWDFLSENQLQTVNFRQRKESVVQHLIHLCEEKRASISDAALLDIIYMQFHQHQKVWEVFQMSKGPGEDVDLFDMKQFKNSFKKILQRALKNVTVSFRETEENAVWIRIAWGTQYTKPNQYKPTYVVYYSQTPYAFTSSSMLRRNTPLLGQ

SEQ ID NO: 13930 - protein, 76 aa, Homo sapiens
  Payload ID: 2707
  Gene Symbol: CENPN
  Gene Name: centromere protein N
  ENSP ID: ENSP00000454337
MDETVAEFIKRTILKIPMNELTTILKAWDFLSENQLQTVNFRQRKESVVQHLIHLCEEKRASISDAALLDIICKCQ

SEQ ID NO: 13931 - protein, 105 aa, Homo sapiens
  Payload ID: 2707
  Gene Symbol: CENPN
  Gene Name: centromere protein N
  ENSP ID: ENSP00000456413
  MOD_RES (1)..(1): Any amino acid
XGEDVDLFDMKQFKNSFKKILQRALKNVTVSFRETEENAVWIRIAWGTQYTKPNQYKPTYVVYYSQTPYAFTSSSMLRRNTPLLGQALTIASKHHQIVKMDLRSR

SEQ ID NO: 13932 - protein, 300 aa, Homo sapiens
  Payload ID: 2708
  Gene Symbol: CENPO
  Gene Name: centromere protein O
  Uniprot ID: Q9BU64
  ENSP ID: ENSP00000260662
MEQANPLRPDGESKGGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 13933 - protein, 300 aa, Homo sapiens; identical to SEQ ID NO: 13932
  Payload ID: 2708
  Gene Symbol: CENPO
  Gene Name: centromere protein O
  Uniprot ID: Q9BU64
  ENSP ID: ENSP00000370214

SEQ ID NO: 13934 - protein, 294 aa, Homo sapiens
  Payload ID: 2708
  Gene Symbol: CENPO
  Gene Name: centromere protein O
  Uniprot ID: Q9BU64
  ENSP ID: ENSP00000417787
MAGILASGLGVLAHLERLETQVSRSRKQSEELQSVQAQEGALGTKIHKLRRLRDELRAVVRHRRASVKACIANVEPNQTVEINEQEALEEKLENVKAILQAYHFTGLSGKLTSRGVCVCISTAFEGNLLDSYFVDLVIQKPLRIHHHSVPVFIPLEEIAAKYLQTNIQHFLFSLCEYLNAYSGRKYQADRLQSDFAALLTGPLQRNPLCNLLSFTYKLDPGGQSFPFCARLLYKDLTATLPTDVTVTCQGVEVLSTSWEEQRASHETLFCTKPLHQVFASFTRKGEKLDMSLVS

SEQ ID NO: 13935 - protein, 102 aa, Homo sapiens
  Payload ID: 2709
  Gene Symbol: CENPP
  Gene Name: centromere protein P
  ENSP ID: ENSP00000364726
MQEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 13936 - protein, 115 aa, Homo sapiens
  Payload ID: 2709
  Gene Symbol: CENPP
  Gene Name: centromere protein P
  Uniprot ID: Q6IPU0
  ENSP ID: ENSP00000364729
MEAPSWSVLQRSGDEEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 13937 - protein, 288 aa, Homo sapiens
  Payload ID: 2709
  Gene Symbol: CENPP
  Gene Name: centromere protein P
  Uniprot ID: Q6IPU0
  ENSP ID: ENSP00000364737
MDAELAEVRALQAEIAALRRACEDPPAPWEEKSRVQKSFQAIHQFNLEGWKSSKDLKNQLGHLESELSFLSTLTGINIRNHSKQTEDLTSTEMTEKSIRKVLQRHRLSGNCHMVTFQLEFQILEIQNKERLSSAVTDLNIIMEPTECSELSEFVSRAEERKDLFMFFRSLHFFVEWFEYRKRTFKHLKEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 13938 - protein, 190 aa, Homo sapiens
  Payload ID: 2709
  Gene Symbol: CENPP
  Gene Name: centromere protein P
  ENSP ID: ENSP00000477821
MDAELAEVRALQAEIAALRRACEDPPAPWEEKSRVQKSFQAIHQFNLEGWKSSKDLKNQLGHLESELSFLSTLTGINIRNHSKQTEDLTSTEMTEKSIRKVLQRHRLSGNCHMVTFQLEFQILEIQNKERLSSAVTDLNIIMEPTECSELSEFVSRAEERKDLFMFFRSLHFFVEWFEYRKRTFKHLKVK

SEQ ID NO: 13939 - protein, 268 aa, Homo sapiens
  Payload ID: 2710
  Gene Symbol: CENPQ
  Gene Name: centromere protein Q
  Uniprot ID: Q7L2Z9
  ENSP ID: ENSP00000337289
MSGKANASKKNAQQLKRNPKRKKDNEEVVLSENKVRNTVKKNKNHLKDLSSEGQTKHTNLKHGKTAASKRKTWQPLSKSTRDHLQTMMESVIMTILSNSIKEKEEIQYHLNFLKKRLLQQCETLKVPPKKMEDLTNVSSLLNMERARDKANEEGLALLQEEIDKMVETTELMTGNIQSLKNKIQILASEVEEEEERVKQMHQINSSGVLSLPELSQKTLKAPTLQKEILALIPNQNALLKDLDILHNSSQMKSMSTFIEEAYKKLDAS

SEQ ID NO: 13940 - protein, 561 aa, Homo sapiens
  Payload ID: 2711
  Gene Symbol: CENPT
  Gene Name: centromere protein T
  Uniprot ID: Q96BT3
  ENSP ID: ENSP00000400140
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 13941 - protein, 64 aa, Homo sapiens
  Payload ID: 2711
  Gene Symbol: CENPT
  Gene Name: centromere protein T
  ENSP ID: ENSP00000454481
MADHNPDSDSTPRTLLRRVLDTADPRTPRRPRSARAGARRALLETASPRKLSGQTRTIARGRSH

SEQ ID NO: 13942 - protein, 79 aa, Homo sapiens
  Payload ID: 2711
  Gene Symbol: CENPT
  Gene Name: centromere protein T
  ENSP ID: ENSP00000454627
MADHNPDSDSTPRTLLRRVLDTADPRTPRRPRSARAGARRALLETASPRKLSGQTRTIARGRSHGARADGQTGCLVLCR

SEQ ID NO: 13943 - protein, 48 aa, Homo sapiens
  Payload ID: 2711
  Gene Symbol: CENPT
  Gene Name: centromere protein T
  ENSP ID: ENSP00000455638
MADHNPDSDSTPRTLLRRVLDTADPRTPRRPRSARAGARRALLETASP

SEQ ID NO: 13944 - protein, 114 aa, Homo sapiens
  Payload ID: 2711
  Gene Symbol: CENPT
  Gene Name: centromere protein T
  ENSP ID: ENSP00000455801
MADHNPDSDSTPRTLLRRVLDTADPRTPRRPRSARAGARRALLETASPRKLSGQTRTIARGRSHGARSVGRSAHIQASGHLEEQTPRTLLKNILLTAPPSPWCFCSPRIFHPDA

SEQ ID NO: 13945 - protein, 73 aa, Homo sapiens
  Payload ID: 2711
  Gene Symbol: CENPT
  Gene Name: centromere protein T
  ENSP ID: ENSP00000455918
MADHNPDSDSTPRTLLRRVLDTADPRTPRRPRSARAGARRALLETASPRKLSGQTRTIARGRSHGARPQNLPS

SEQ ID NO: 13946 - protein, 73 aa, Homo sapiens; identical to SEQ ID NO: 13945
  Payload ID: 2711
  Gene Symbol: CENPT
  Gene Name: centromere protein T
  ENSP ID: ENSP00000456714

SEQ ID NO: 13947 - protein, 506 aa, Homo sapiens
  Payload ID: 2711
  Gene Symbol: CENPT
  Gene Name: centromere protein T
  ENSP ID: ENSP00000457294
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 13948 - protein, 101 aa, Homo sapiens
  Payload ID: 2711
  Gene Symbol: CENPT
  Gene Name: centromere protein T
  ENSP ID: ENSP00000457304
MADHNPDSDSTPRTLLRRVLDTADPRTPRRPRSARAGARRALLETASPRKLSGQTRTIARGRSHGARTDRLVAWCFADSLLADRPIFRPVGTWRNRHLGRC

SEQ ID NO: 13949 - protein, 561 aa, Homo sapiens; identical to SEQ ID NO: 13940
  Payload ID: 2711
  Gene Symbol: CENPT
  Gene Name: centromere protein T
  Uniprot ID: Q96BT3
  ENSP ID: ENSP00000457810

SEQ ID NO: 13950 - protein, 277 aa, Homo sapiens
  Payload ID: 2711
  Gene Symbol: CENPT
  Gene Name: centromere protein T
  ENSP ID: ENSP00000457832
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEK

SEQ ID NO: 13951 - protein, 6 aa, Homo sapiens
  Payload ID: 2711
  Gene Symbol: CENPT
  Gene Name: centromere protein T
  ENSP ID: ENSP00000460542
MADHNP

SEQ ID NO: 13952 - protein, 163 aa, Homo sapiens
  Payload ID: 2711
  Gene Symbol: CENPT
  Gene Name: centromere protein T
  ENSP ID: ENSP00000461212
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGRSAGPWQEETEAETVSVSAGSGPGAVSLPRASREC

SEQ ID NO: 13953 - protein, 73 aa, Homo sapiens; identical to SEQ ID NO: 13945
  Payload ID: 2711
  Gene Symbol: CENPT
  Gene Name: centromere protein T
  ENSP ID: ENSP00000487410

SEQ ID NO: 13954 - protein, 418 aa, Homo sapiens
  Payload ID: 2712
  Gene Symbol: CENPU
  Gene Name: centromere protein U
  Uniprot ID: Q71F23
  ENSP ID: ENSP00000281453
MAPRGRRRPRPHRSEGARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 13955 - protein, 177 aa, Homo sapiens
  Payload ID: 2712
  Gene Symbol: CENPU
  Gene Name: centromere protein U
  ENSP ID: ENSP00000423167
MKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQS

SEQ ID NO: 13956 - protein, 320 aa, Homo sapiens
  Payload ID: 2712
  Gene Symbol: CENPU
  Gene Name: centromere protein U
  ENSP ID: ENSP00000423248
MAPRGRRRPRPHRSEGARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKVRATAETTTNKI

SEQ ID NO: 13957 - protein, 272 aa, Homo sapiens
  Payload ID: 2713
  Gene Symbol: CENPV
  Gene Name: centromere protein V
  Uniprot ID: Q7Z7K6
  ENSP ID: ENSP00000299736
MRRSRSSAAAKLRGQKRSGASAAPAASAAAALAPSATRTRRSASQAGSKSQAVEKPPSEKPRLRRSSPRAQEEGPGEPPPPELALLPPPPPPPPTPATPTSSASNLDLGEQRERWETFQKRQKLTSEGAAKLLLDTFEYQGLVKHTGGCHCGAVRFEVWASADLHIFDCNCSICKKKQNRHFIVPASRFKLLKGAEHITTYTFNTHKAQHTFCKRCGVQSFYTPRSNPGGFGIAPHCLDEGTVRSMVTEEFNGSDWEKAMKEHKTIKNMSKE

SEQ ID NO: 13958 - protein, 175 aa, Homo sapiens
  Payload ID: 2713
  Gene Symbol: CENPV
  Gene Name: centromere protein V
  ENSP ID: ENSP00000462377
MRRSRSSAAAKLRGQKRSGASAAPAASAAAALAPSATRTRRSASQAGSKSQAVEKPPSEKPRLRRSSPRAQEEGPGEPPPPELALLPPPPPPPPTPATPTSSASNLDLGEQRERWETFQKRQKLTSEGAAKLLLDTFEYQGLVKHTGGCHCGAVRFEVWASADLHIFDCKYRNYI

SEQ ID NO: 13959 - protein, 14 aa, Homo sapiens
  Payload ID: 2713
  Gene Symbol: CENPV
  Gene Name: centromere protein V
  ENSP ID: ENSP00000468338
ADLHIFDCKYRNYI

SEQ ID NO: 13960 - protein, 272 aa, Homo sapiens
  Payload ID: 2714
  Gene Symbol: CENPVP1
  Gene Name: centromere protein V pseudogene 1
  ENSP ID: ENSP00000489273
MGRVRNRATAQRRRRKRPGDPPAACAAIAVTGASRAQCPRVQVGVGSHAAAKRWLGRWRRKRRWRRVRKAGPRDLLPSAPTPDPPGPAPSPKDLDLGAQRERWETFRKLRGLSCEGAAKVLLDTFEYPGLVHHTGGCHCGAVRFAVWAPADLRVVDCSCRLCRKKQHRHFLVPASRFTLLQGAESIVTYRSNTHPALHSFCSRCGVQSFHAAVSDPRVYGVAPHCLDEGTVRSVVIEEVGGGDPGEEAAEEHKAIHKTSSQSAPACPREQEQ

SEQ ID NO: 13961 - protein, 287 aa, Homo sapiens
  Payload ID: 2715
  Gene Symbol: CENPVP3
  Gene Name: centromere protein V pseudogene 3
  ENSP ID: ENSP00000489547
MGVAGWARAPEAAGAMGRVRNRATAQRRRRKRPGDPPAACAAIAVMGASRAQCPRVQVGVGSHAAAKRWLGKLRRKRRWRRAREAGSRDPLPSAPLPDPPAPAESPKELDLGAQRERWETFRKLWGLSCEGAAKVLLDTFEYPGLVHHTGGCHCGAVRFAVWAPADLRVVDCSCRLCRKKQHRHFLVPASRFTLLQGAESIVTYRSNTHPALHSFCSRCGVQSFHAAVSDPRVYGVAPHCLDEGTVRSVVIEEVGGGDPGEEAAEEHKAIHKTSSQSAPACPREQEQ

SEQ ID NO: 13962 - protein, 103 aa, Homo sapiens
  Payload ID: 2716
  Gene Symbol: CENPW
  Gene Name: centromere protein W
  Uniprot ID: Q5EE01
  ENSP ID: ENSP00000357308
MALSTIVSQRKQIKRKAPRGFLKRVFKRKKPQLRLEKSGDLLVRFHPFSGWEWGTGEVHLNCLLFVHRLAEESRTNACASKCRVINKEHVLAAAKVILKKSRG

SEQ ID NO: 13963 - protein, 67 aa, Homo sapiens
  Payload ID: 2716
  Gene Symbol: CENPW
  Gene Name: centromere protein W
  ENSP ID: ENSP00000357309
MALSTIVSQRKQIKRKAPRGFLKRVFKRKKPQLRLEKSGDLLKSPGQTLVRVNVESLTRSMYWPQQR

SEQ ID NO: 13964 - protein, 88 aa, Homo sapiens
  Payload ID: 2716
  Gene Symbol: CENPW
  Gene Name: centromere protein W
  Uniprot ID: Q5EE01
  ENSP ID: ENSP00000357311
MALSTIVSQRKQIKRKAPRGFLKRVFKRKKPQLRLEKSGDLLVHLNCLLFVHRLAEESRTNACASKCRVINKEHVLAAAKVILKKSRG

SEQ ID NO: 13965 - protein, 244 aa, Homo sapiens
  Payload ID: 2717
  Gene Symbol: CEP104
  Gene Name: centrosomal protein 104kDa
  Uniprot ID: O60308
  ENSP ID: ENSP00000367468
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYASSVRTGGESTFGELKGPAVPSSVTLSVLGTSLGQWFPCHLPAVDDNEGTPFQRCLV

SEQ ID NO: 13966 - protein, 925 aa, Homo sapiens
  Payload ID: 2717
  Gene Symbol: CEP104
  Gene Name: centrosomal protein 104kDa
  Uniprot ID: O60308
  ENSP ID: ENSP00000367476
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 13967 - protein, 199 aa, Homo sapiens
  Payload ID: 2717
  Gene Symbol: CEP104
  Gene Name: centrosomal protein 104kDa
  ENSP ID: ENSP00000394989
MPHKIGFVVVSSSGHEDGFSARELMIHAPTVSGWRSPSYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEK

SEQ ID NO: 13968 - protein, 190 aa, Homo sapiens
  Payload ID: 2717
  Gene Symbol: CEP104
  Gene Name: centrosomal protein 104kDa
  ENSP ID: ENSP00000395283
  MOD_RES (1)..(1): Any amino acid
XQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGEGQRR

SEQ ID NO: 13969 - protein, 143 aa, Homo sapiens
  Payload ID: 2717
  Gene Symbol: CEP104
  Gene Name: centrosomal protein 104kDa
  ENSP ID: ENSP00000411927
RLGRYEVEKRCAVEKEDYDLAKEKKQQMEQYRAEVYEQLELHSLLDAELHSAVDPLLPATDPHPKINAESLPYDERPLPAIRKHYGEAVVEPEMSNADISDARRGGMLGEPEPLTEKALREASSAIDVLGETLVAEAYCKTWS

SEQ ID NO: 13970 - protein, 185 aa, Homo sapiens
  Payload ID: 2717
  Gene Symbol: CEP104
  Gene Name: centrosomal protein 104kDa
  ENSP ID: ENSP00000463605
ARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEVRGLGRRDQ

SEQ ID NO: 13971 - protein, 211 aa, Homo sapiens
  Payload ID: 2718
  Gene Symbol: CEP112
  Gene Name: centrosomal protein 112kDa
  Uniprot ID: Q8N8E3
  ENSP ID: ENSP00000320592
MWASLSLDHPSAKENQALRLIEMREENGNVPKTEQAGSLKPLRDTGKSNLKEKKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 13972 - protein, 955 aa, Homo sapiens
  Payload ID: 2718
  Gene Symbol: CEP112
  Gene Name: centrosomal protein 112kDa
  Uniprot ID: Q8N8E3
  ENSP ID: ENSP00000376522
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGIENPRYLRQKPIPVSLMTPKFSLRKSSSFHDDHFLSRIREKELDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 13973 - protein, 913 aa, Homo sapiens
  Payload ID: 2718
  Gene Symbol: CEP112
  Gene Name: centrosomal protein 112kDa
  ENSP ID: ENSP00000440775
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGLDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 13974 - protein, 955 aa, Homo sapiens; identical to SEQ ID NO: 13972
  Payload ID: 2718
  Gene Symbol: CEP112
  Gene Name: centrosomal protein 112kDa
  Uniprot ID: Q8N8E3
  ENSP ID: ENSP00000442784

SEQ ID NO: 13975 - protein, 53 aa, Homo sapiens
  Payload ID: 2718
  Gene Symbol: CEP112
  Gene Name: centrosomal protein 112kDa
  ENSP ID: ENSP00000462567
QKFEDEKKQLIRDNDQAIKVLQDELENRSNQVRCAEKKLQHKELESQEQMKCR

SEQ ID NO: 13976 - protein, 46 aa, Homo sapiens
  Payload ID: 2718
  Gene Symbol: CEP112
  Gene Name: centrosomal protein 112kDa
  ENSP ID: ENSP00000463445
  MOD_RES (1)..(1): Any amino acid
XLMPASLRQELEDTISSLKSQVNFLQKRASILQEELTTYQGRRYSP

SEQ ID NO: 13977 - protein, 565 aa, Homo sapiens
  Payload ID: 2718
  Gene Symbol: CEP112
  Gene Name: centrosomal protein 112kDa
  ENSP ID: ENSP00000463914
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGIENPRYLRQKPIPVSLMTPKFSLRKSSSFHDDHFLSRIREKELDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKE

SEQ ID NO: 13978 - protein, 14 aa, Homo sapiens
  Payload ID: 2718
  Gene Symbol: CEP112
  Gene Name: centrosomal protein 112kDa
  ENSP ID: ENSP00000464164
MGRKNRNLYAKLLL

SEQ ID NO: 13979 - protein, 105 aa, Homo sapiens
  Payload ID: 2718
  Gene Symbol: CEP112
  Gene Name: centrosomal protein 112kDa
  ENSP ID: ENSP00000464597
ANSKLKQIEKEYTQKLAKSSQIIAELQTTISSLKEENSQQQLAAERRLQDVRQKFEDEKKQLIRDNDQAIKVLQDELENRSNQVNFLQKRASILQEELTTYQGRR

SEQ ID NO: 13980 - protein, 986 aa, Homo sapiens
  Payload ID: 2719
  Gene Symbol: CEP120
  Gene Name: centrosomal protein 120kDa
  Uniprot ID: Q8N960
  ENSP ID: ENSP00000303058
MVSKSDQLLIVVSILEGRHFPKRPKHMLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQSLIELKTQNEHEPEHSKKKVLTPIKEKTLTGPKSPTVSPVPSHNQSPPTKDDATESEVESLQYDKDTKPNPKASSSVPASLAQLVTTSNASEVASGQKIAVPATSHHFCFSIDLRSIHALEIGFPINCILRYSYPFFGSAAPIMTNPPVEVRKNMEVFLPQSYCAFDFATMPHQLQDTFLRIPLLVELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 13981 - protein, 960 aa, Homo sapiens
  Payload ID: 2719
  Gene Symbol: CEP120
  Gene Name: centrosomal protein 120kDa
  Uniprot ID: Q8N960
  ENSP ID: ENSP00000307419
MLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQSLIELKTQNEHEPEHSKKKVLTPIKEKTLTGPKSPTVSPVPSHNQSPPTKDDATESEVESLQYDKDTKPNPKASSSVPASLAQLVTTSNASEVASGQKIAVPATSHHFCFSIDLRSIHALEIGFPINCILRYSYPFFGSAAPIMTNPPVEVRKNMEVFLPQSYCAFDFATMPHQLQDTFLRIPLLVELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 13982 - protein, 986 aa, Homo sapiens; identical to SEQ ID NO: 13980
  Payload ID: 2719
  Gene Symbol: CEP120
  Gene Name: centrosomal protein 120kDa
  Uniprot ID: Q8N960
  ENSP ID: ENSP00000327504

SEQ ID NO: 13983 - protein, 844 aa, Homo sapiens
  Payload ID: 2719
  Gene Symbol: CEP120
  Gene Name: centrosomal protein 120kDa
  ENSP ID: ENSP00000421620
MLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQSLIELKTQNEHEPEHSKKKVLTPIKEKTLTGPKSPTVSPVPSHNQSPPTKDDATESEVESLQYDKDTKPNPKASSSVPASLAQLVTTSNASEVASGQKIAVPATSHHFCFSIDLRSIHALEIGFPINCILRYSYPFFGSAAPIMTNPPVEVRKNMEVFLPQSYCAFDFATMPHQLQDTFLRIPLLVELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARL

SEQ ID NO: 13984 - protein, 380 aa, Homo sapiens
  Payload ID: 2719
  Gene Symbol: CEP120
  Gene Name: centrosomal protein 120kDa
  Uniprot ID: Q8N960
  ENSP ID: ENSP00000422089
MVSKSDQLLIVVSILEGRHFPKRPKHMLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPRDIVAVLNEEGGYHQIGPAEYCTDSFIMSVTIAFATQLEQLIPCTMKLPERQPEFFFYYSLLGNDVTNEPFNDLINPNFEPERASVRIRSSVEILRVYLALQSKLQIHLCCGDQSLGSTEIPLTGLLKKGSTEINQHPVTVEGAFTLDPPNRAKQKLAPIPVELAPTVGVSVALQREGIDSQDAFWYSALDIIFPLFIFLFLVLDAIRKFANYEEK

SEQ ID NO: 13985 - protein, 200 aa, Homo sapiens
  Payload ID: 2719
  Gene Symbol: CEP120
  Gene Name: centrosomal protein 120kDa
  ENSP ID: ENSP00000422234
MVSKSDQLLIVVSILEGRHFPKRPKHMLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKEISSNRCHVLPIASYQAQQDVPSSSCAYSVSALDSAISLRSPASFR

SEQ ID NO: 13986 - protein, 165 aa, Homo sapiens
  Payload ID: 2719
  Gene Symbol: CEP120
  Gene Name: centrosomal protein 120kDa
  ENSP ID: ENSP00000422382
MVSKSDQLLIVVSILEGRHFPKRPKHMLVVEAKFDGEQLATDPVDHTDQPEFATELAWEIDRKALHQHRLQRTPIKLQCFALDPVTSAKETIGYIVLDLRTAQETKQAPKWYQLLSNKYTKFKSEIQISIALETDTKPPVDSFKAKGAPPRDGKVPAILAGLDPR

SEQ ID NO: 13987 - protein, 70 aa, Homo sapiens
  Payload ID: 2719
  Gene Symbol: CEP120
  Gene Name: centrosomal protein 120kDa
  ENSP ID: ENSP00000428303
MVSKSDQLLIVVSILEGFLRFQKCSGGNSLYTSCWRTQGTTVLKRVYYTFLKRSAFPQTSKAYACSGSKV

SEQ ID NO: 13988 - protein, 1117 aa, Homo sapiens
  Payload ID: 2720
  Gene Symbol: CEP126
  Gene Name: centrosomal protein 126kDa
  Uniprot ID: Q9P2H0
  ENSP ID: ENSP00000263468
MLAGRPGTRSAVGELGTESSDNLDRAPLGPRESGGHHRPGSYLDMKIHLEKNLEEERQILLQQQKICRNRARKYFVESNRRKKAFEEKRKEQEEKEHQIREQILQQRKQKFEEVTEKFQRAHVPLSQRRKAVSRKPVPPLEEALKQIQESNLKSEVNLPFSRRPTINWRAIDSALPSALSKNDHKHQKQLLSKINCEKEMNENMRATLATSKNVFQLKLEETQKLLEDQHLSNLQKFCDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLSERLHYIQESICKNPSIKNTLQIIPLLEKREDRTSSCRDKR

SEQ ID NO: 13989 - protein, 432 aa, Homo sapiens
  Payload ID: 2720
  Gene Symbol: CEP126
  Gene Name: centrosomal protein 126kDa
  ENSP ID: ENSP00000433643
  MOD_RES (1)..(1): Any amino acid
XAHVPLSQRRKAVSRKPVPPLEEALKQIQESNLKSEVNLPFSRRPTINWRSIPACPAVSTPDPYLPDQLSPPRVPLRSHHFQILPSYPTVSPARQPHILPIHPSVPSTLPKTFAPVPLLPYPIKYHPCPPTPATSSISSSFPRLPAPIPSCPPGHPPHAPQSSPIIPDPESQHKLFYKTFRPKHFLPAQHSTAATLMPTLVRRSLPAPLVVSPTPLEPLPVLKPSCLSSHPPYPPVPTLSYVTPLPAHPASLDPFQSVQQSVPQATALSNQPEAFADHPPASVLSLASPCHSPSSSLPSSPSTSTSFSSACILFSSSSSILSSSSTSCSTSPSLPPSSIPLFSSPLHSSSSPGLPPTYLAFPSPVSPVSSSFMISSSFPPILHSPSVSTSPSPFIPIHPFNPPHWGKKVEKRREESGVEKKGIEKKVETRQL

SEQ ID NO: 13990 - protein, 81 aa, Homo sapiens
  Payload ID: 2720
  Gene Symbol: CEP126
  Gene Name: centrosomal protein 126kDa
  ENSP ID: ENSP00000437014
  MOD_RES (1)..(1): Any amino acid
XEQKRQNPGSVGQKYSEQINNFGQSVLLSSSEPKQTTRGTSYIEEDIQESICKNPSIKNTLQIIPLLEKREDRTSSCRDKR

SEQ ID NO: 13991 - protein, 435 aa, Homo sapiens
  Payload ID: 2721
  Gene Symbol: CEP128
  Gene Name: centrosomal protein 128kDa
  Uniprot ID: Q6ZU80
  ENSP ID: ENSP00000216517
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVEHINRKCLLNLVQDLDCKDNEILTYSLQSPLHV

SEQ ID NO: 13992 - protein, 1094 aa, Homo sapiens
  Payload ID: 2721
  Gene Symbol: CEP128
  Gene Name: centrosomal protein 128kDa
  Uniprot ID: Q6ZU80
  ENSP ID: ENSP00000281129
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVENLTRELENGEKQQLQMLDRLKEIQNHFDTCEAERKHADLQISELTRHAEDATKQAERYLSELQQSEALKEEAEKRREDLKLKAQESIRQWKLKHKKLERALEKQSETVDELTGKNNQILKEKDELKTQLYAALQQIENLRKELNDVLTKRALQEEELHSKEEKLRDIKSHQADLELEVKNSLDTIHRLESELKKQSKIQSQMKVEKAHLEEEIAELKKSQAQDKAKLLEMQESIKDLSAIRADLANKLAEEERAKKAVLKDLSDLTAQAKSRDEETATIITQLKLERDVHQRELKDLTSSLQSVKTKHEQNIQELMKHFKKEKSEAENHIRTLKAESLEEKNMAKIHRGQLEKLKSQCDRLTEELTQNENENKKLKLKYQCLKDQLEEREKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVPEKLSLLEDFKDFRDSCSSSERTDGRYSKYRVRRNSLQHHQDDTKYRTKSFKGDRTFLEGSHTRGLDHSSSWQDHSRFLSSPRFSYVNSFTKRTVAPDSASNKEDATMNGTSSQPKKEEYGS

SEQ ID NO: 13993 - protein, 302 aa, Homo sapiens
  Payload ID: 2721
  Gene Symbol: CEP128
  Gene Name: centrosomal protein 128kDa
  ENSP ID: ENSP00000450555
  MOD_RES (1)..(1): Any amino acid
XHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVEVTLLFLSHIRNILILSHGIA

SEQ ID NO: 13994 - protein, 179 aa, Homo sapiens
  Payload ID: 2721
  Gene Symbol: CEP128
  Gene Name: centrosomal protein 128kDa
  ENSP ID: ENSP00000451137
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLG

SEQ ID NO: 13995 - protein, 1094 aa, Homo sapiens; identical to SEQ ID NO: 13992
  Payload ID: 2721
  Gene Symbol: CEP128
  Gene Name: centrosomal protein 128kDa
  Uniprot ID: Q6ZU80
  ENSP ID: ENSP00000451162

SEQ ID NO: 13996 - protein, 127 aa, Homo sapiens
  Payload ID: 2721
  Gene Symbol: CEP128
  Gene Name: centrosomal protein 128kDa
  ENSP ID: ENSP00000451214
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPP

SEQ ID NO: 13997 - protein, 139 aa, Homo sapiens
  Payload ID: 2721
  Gene Symbol: CEP128
  Gene Name: centrosomal protein 128kDa
  ENSP ID: ENSP00000451273
EEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRGVC

SEQ ID NO: 13998 - protein, 679 aa, Homo sapiens
  Payload ID: 2721
  Gene Symbol: CEP128
  Gene Name: centrosomal protein 128kDa
  ENSP ID: ENSP00000451319
  MOD_RES (1)..(1): Any amino acid
XEELRTQLTKAEGDRKGLQHQVSQISKQQSNYQDEQGEDWRFRRGVEREKQDLEKQMSDLRVQLNFSAMASELEEVKRCMERKDKEKAHLASQVENLTRELENGEKQQLQMLDRLKEIQNHFDTCEAERKHADLQISELTRHAEDATKQAERYLSELQQSEALKEEAEKRREDLKLKAQESIRQWKLKHKKLERALEKQSETVDELTGKNNQILKEKDELKTQLYAALQQIENLRKELNDVLTKRALQEEELHSKEEKLRDIKSHQADLELEVKNSLDTIHRLESELKKQSKIQSQMKVEKAHLEEEIAELKKSQAQDKAKLLEMQESIKDLSAIRADLANKLAEEERAKKAVLKDLSDLTAQAKSRDEETATIITQLKLERDVHQRELKDLTSSLQSVKTKHEQNIQELMKHFKKEKSEAENHIRTLKAESLEEKNMAKIHRGQLEKLKSQCDRLTEELTQNENENKKLKLKYQCLKDQLEEREKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVPEKLSLLEDFKDFRR

SEQ ID NO: 13999 - protein, 32 aa, Homo sapiens
  Payload ID: 2721
  Gene Symbol: CEP128
  Gene Name: centrosomal protein 128kDa
  ENSP ID: ENSP00000451428
MAESSSESDHFRCRDRLSPWAARSTHRGTRSL

SEQ ID NO: 14000 - protein, 160 aa, Homo sapiens
  Payload ID: 2721
  Gene Symbol: CEP128
  Gene Name: centrosomal protein 128kDa
  ENSP ID: ENSP00000451501
  MOD_RES (1)..(1): Any amino acid
XDLLEETQRKDEEMGSLQDRVIALETSTQVALDHLESVPEKLSLLEDFKDFRDSCSSSERTDGRYSKYRVRRNSLQHHQDDTKYRTKSFKGDRTFLEGSHTRGLDHSSSWQDHSRFLSSPRFSYVNSFTKRTVAPDSASNKEDATMNGTSSQPKKEEYGS

SEQ ID NO: 14001 - protein, 20 aa, Homo sapiens
  Payload ID: 2721
  Gene Symbol: CEP128
  Gene Name: centrosomal protein 128kDa
  ENSP ID: ENSP00000451849
MLGRYREYSNGQAGAIEHVR

SEQ ID NO: 14002 - protein, 1083 aa, Homo sapiens
  Payload ID: 2722
  Gene Symbol: CEP131
  Gene Name: centrosomal protein 131kDa
  Uniprot ID: Q9UPN4
  ENSP ID: ENSP00000269392
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEVTTEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 14003 - protein, 1044 aa, Homo sapiens
  Payload ID: 2722
  Gene Symbol: CEP131
  Gene Name: centrosomal protein 131kDa
  Uniprot ID: Q9UPN4
  ENSP ID: ENSP00000363914
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 14004 - protein, 1080 aa, Homo sapiens
  Payload ID: 2722
  Gene Symbol: CEP131
  Gene Name: centrosomal protein 131kDa
  Uniprot ID: Q9UPN4
  ENSP ID: ENSP00000393583
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 14005 - protein, 1047 aa, Homo sapiens
  Payload ID: 2722
  Gene Symbol: CEP131
  Gene Name: centrosomal protein 131kDa
  ENSP ID: ENSP00000459733
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEVTTEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 14006 - protein, 524 aa, Homo sapiens
  Payload ID: 2722
  Gene Symbol: CEP131
  Gene Name: centrosomal protein 131kDa
  ENSP ID: ENSP00000460006
LGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKERMSPQEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 14007 - protein, 206 aa, Homo sapiens
  Payload ID: 2722
  Gene Symbol: CEP131
  Gene Name: centrosomal protein 131kDa
  ENSP ID: ENSP00000460098
  MOD_RES (1)..(1): Any amino acid
XKQQLELERQAWEAGRTRKEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKR

SEQ ID NO: 14008 - protein, 307 aa, Homo sapiens
  Payload ID: 2722
  Gene Symbol: CEP131
  Gene Name: centrosomal protein 131kDa
  ENSP ID: ENSP00000461374
  MOD_RES (1)..(1): Any amino acid
XASQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEVSPCGQPCWTSGLGAGLTLWVCCRLR

SEQ ID NO: 14009 - protein, 1140 aa, Homo sapiens
  Payload ID: 2723
  Gene Symbol: CEP135
  Gene Name: centrosomal protein 135kDa
  Uniprot ID: Q66GS9
  ENSP ID: ENSP00000257287
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQIELREREIERLSVALDGGRSPDVLSLESRNKTNEKLIAHLNIQVDFLQQANKDLEKRIRELMETKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKEKLTLSESKLTSQSRENTMLRAKVAQLQTDYDALKRQISTERYERERAIQEMRRHGLATPPLSSTLRSPSHSPEHRNV

SEQ ID NO: 14010 - protein, 249 aa, Homo sapiens
  Payload ID: 2723
  Gene Symbol: CEP135
  Gene Name: centrosomal protein 135kDa
  Uniprot ID: Q66GS9
  ENSP ID: ENSP00000412799
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQVGFLFTCIVGIEIGML

SEQ ID NO: 14011 - protein, 1275 aa, Homo sapiens
  Payload ID: 2724
  Gene Symbol: CEP152
  Gene Name: centrosomal protein 152kDa
  Uniprot ID: O94986
  ENSP ID: ENSP00000321000
MSLDFGSVALPVQNEDEEYDEEDYEREKELQQLLTDLPHDMLDDDLSSPELQYSDCSEDGTDGQPHHPEQLEMSWNEQMLPKSQSVNGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEADKKKVLEIKDLCCGHCFQELEKAKQECQDLKGKLEKCCRHLQHLERKHKAVVEKIGEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSGMSK

SEQ ID NO: 14012 - protein, 1710 aa, Homo sapiens
  Payload ID: 2724
  Gene Symbol: CEP152
  Gene Name: centrosomal protein 152kDa
  Uniprot ID: O94986
  ENSP ID: ENSP00000370337
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEADKKKVLEIKDLCCGHCFQELEKAKQECQDLKGKLEKCCRHLQHLERKHKAVVEKIGEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSALPLTSEMLIAVKKSKRNDVNQKIPCCIESKSNSVNTITRTLCEQAPKRRAACNLQRLLENSEHQSIKHVGSKETHLEFQFGDGSCKHLNSLPRNVSPEFVPCEGEGGFGLHKKKDLLSDNGSESLPHSAAYPFLGTLGNKPSPRCTPGPSESGCMHITFRDSNERLGLKVYKCNPLMESENAASEKSQGLDVQEPPVKDGGDLSDCLGWPSSSATLSFDSREASFVHGRPQGTLEIPSESVKSKQFSPSGYLSDTEESNMICQTMKCQRYQTPYLSEETTYLEPGKISVNCGHPSRHKADRLKSDFKKLSSTLPSSVCQQPSRKLIVPLSSQQDSGFDSPFVNLD

SEQ ID NO: 14013 - protein, 1654 aa, Homo sapiens
  Payload ID: 2724
  Gene Symbol: CEP152
  Gene Name: centrosomal protein 152kDa
  Uniprot ID: O94986
  ENSP ID: ENSP00000382271
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEAEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSALPLTSEMLIAVKKSKRNDVNQKIPCCIESKSNSVNTITRTLCEQAPKRRAACNLQRLLENSEHQSIKHVGSKETHLEFQFGDGSCKHLNSLPRNVSPEFVPCEGEGGFGLHKKKDLLSDNGSESLPHSAAYPFLGTLGNKPSPRCTPGPSESGCMHITFRDSNERLGLKVYKCNPLMESENAASEKSQGLDVQEPPVKDGGDLSDCLGWPSSSATLSFDSREASFVHGRPQGTLEIPSESVKSKQFSPSGYLSDTEESNMICQTMKCQRYQTPYLSEETTYLEPGKISVNCGHPSRHKADRLKSDFKKLSSTLPSSVCQQPSRKLIVPLSSQQDSGFDSPFVNLD

SEQ ID NO: 14014 - protein, 584 aa, Homo sapiens
  Payload ID: 2724
  Gene Symbol: CEP152
  Gene Name: centrosomal protein 152kDa
  ENSP ID: ENSP00000453440
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQV

SEQ ID NO: 14015 - protein, 64 aa, Homo sapiens
  Payload ID: 2724
  Gene Symbol: CEP152
  Gene Name: centrosomal protein 152kDa
  ENSP ID: ENSP00000453591
ARKMRKYYLICLQQILQDDGKEGAEKKIMNAASKLATMAKLLETPISSEEAKSQKDNSPKRTQG

SEQ ID NO: 14016 - protein, 68 aa, Homo sapiens
  Payload ID: 2724
  Gene Symbol: CEP152
  Gene Name: centrosomal protein 152kDa
  ENSP ID: ENSP00000453914
MSLDFGSVALPVQNEDEEYDEEDYEREKELQQLLTDLPHDMLDDDLSSPELQYSDCSEDGTDGQPHHP

SEQ ID NO: 14017 - protein, 1327 aa, Homo sapiens
  Payload ID: 2725
  Gene Symbol: CEP162
  Gene Name: centrosomal protein 162kDa
  Uniprot ID: Q5TB80
  ENSP ID: ENSP00000257766
MEIEEESAEKIQFLKSSGTSLLSTDSLETNELVVSELNHSSLGVGLDTLEEQEEKEQFFARLEKGLTSSIDYSRLNKELDSNDSTHFKALHSNQANAELTDDEHENESKHEELAENYSDDFEDEYVGAPLTTKDEEMPSKENSKSEKISVPKQEEEKTGMLANVVLLDSLDSVAEVNLDEQDKITPKPRCLPEMTENEMTGTGVSYGQSSSDVEALHQAYCHIAHSLGDEDKQKIESNTVEDIKSSVKGHPQENEENSKNISTMESDLPTVEELMKPIRIDSFGISGFDLQPVSSEKVAERKETEFFSSLPLKMNPNILSQDSQHVNLFFDKNDENVILQKTTNESMENSCPQVTEVTATEEHVDKMYLNILRKKITVNSSSLSQDDKINKTYRSQLSSEEEGAVMGKQVPYKKARSAPPLLKRKPQSGLYASVRSSGYGKPSSPLKMFSTLEKKTSEDIIKSKNLRSISTSNQPRKKEILSGTKLIKPAALDKPAHKTESCLSTRKKSENPTETDSCIQFQTDSLGYCGENKEKKLLMFKRVQEAEDKWRGAQALIEQIKATFSEKEKELENKLEELKKQQEKELFKLNQDNYILQAKLSSFEETNKKQRWLHFGEAADPVTGEKLKQIQKEIQEQETLLQGYQQENERLYNQVKDLQEQNKKNEERMFKENQSLFSEVASLKEQMHKSRFLSQVVEDSEPTRNQNFTDLLAELRMAQKEKDSLLEDIKRLKQDKQALEVDFEKMKKERDQAKDQIAYVTGEKLYEIKILEETHKQEISRLQKRLQWYAENQELLDKDALRLREANEEIEKLKLEIEKLKAESGNPSIRQKIRLKDKAADAKKIQDLERQVKEMEGILKRRYPNSLPALILAASAAGDTVDKNTVEFMEKRIKKLEADLEGKDEDAKKSLRTMEQQFQKMKIQYEQRLEQQEQLLACKLNQHDSPRIKALEKELDDIKEAHQITVRNLEAEIDVLKHQNAELDVKKNDKDDEDFQSIEFQVEQAHAKAKLVRLNEELAAKKREIQDLSKTVERLQKDRRMMLSNQNSKGREEMSAKRAKKDVLHSSKGNANSFPGTLDSKLYQPHTFTDSHVSEVLQENYRLKNELEGLISEKNELKMKSEAVMNQFENSMRRVKEDTAAHIASLKASHQREIEKLLCQNAVENSSSKVAELNRKIATQEVLIRHFQSQVNELQSKQESLVVSEVREEILQKEITKLLEELREAKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 14018 - protein, 1403 aa, Homo sapiens
  Payload ID: 2725
  Gene Symbol: CEP162
  Gene Name: centrosomal protein 162kDa
  Uniprot ID: Q5TB80
  ENSP ID: ENSP00000385215
MANCSQEELDEEFEQFMKELSDDSFENSDKTARQSKKEMKKKDTVPWWITEDDFKDDGLLGTNVSYLKTKKTSQPVMEIEEESAEKIQFLKSSGTSLLSTDSLETNELVVSELNHSSLGVGLDTLEEQEEKEQFFARLEKGLTSSIDYSRLNKELDSNDSTHFKALHSNQANAELTDDEHENESKHEELAENYSDDFEDEYVGAPLTTKDEEMPSKENSKSEKISVPKQEEEKTGMLANVVLLDSLDSVAEVNLDEQDKITPKPRCLPEMTENEMTGTGVSYGQSSSDVEALHQAYCHIAHSLGDEDKQKIESNTVEDIKSSVKGHPQENEENSKNISTMESDLPTVEELMKPIRIDSFGISGFDLQPVSSEKVAERKETEFFSSLPLKMNPNILSQDSQHVNLFFDKNDENVILQKTTNESMENSCPQVTEVTATEEHVDKMYLNILRKKITVNSSSLSQDDKINKTYRSQLSSEEEGAVMGKQVPYKKARSAPPLLKRKPQSGLYASVRSSGYGKPSSPLKMFSTLEKKTSEDIIKSKNLRSISTSNQPRKKEILSGTKLIKPAALDKPAHKTESCLSTRKKSENPTETDSCIQFQTDSLGYCGENKEKKLLMFKRVQEAEDKWRGAQALIEQIKATFSEKEKELENKLEELKKQQEKELFKLNQDNYILQAKLSSFEETNKKQRWLHFGEAADPVTGEKLKQIQKEIQEQETLLQGYQQENERLYNQVKDLQEQNKKNEERMFKENQSLFSEVASLKEQMHKSRFLSQVVEDSEPTRNQNFTDLLAELRMAQKEKDSLLEDIKRLKQDKQALEVDFEKMKKERDQAKDQIAYVTGEKLYEIKILEETHKQEISRLQKRLQWYAENQELLDKDALRLREANEEIEKLKLEIEKLKAESGNPSIRQKIRLKDKAADAKKIQDLERQVKEMEGILKRRYPNSLPALILAASAAGDTVDKNTVEFMEKRIKKLEADLEGKDEDAKKSLRTMEQQFQKMKIQYEQRLEQQEQLLACKLNQHDSPRIKALEKELDDIKEAHQITVRNLEAEIDVLKHQNAELDVKKNDKDDEDFQSIEFQVEQAHAKAKLVRLNEELAAKKREIQDLSKTVERLQKDRRMMLSNQNSKGREEMSAKRAKKDVLHSSKGNANSFPGTLDSKLYQPHTFTDSHVSEVLQENYRLKNELEGLISEKNELKMKSEAVMNQFENSMRRVKEDTAAHIASLKASHQREIEKLLCQNAVENSSSKVAELNRKIATQEVLIRHFQSQVNELQSKQESLVVSEVREEILQKEITKLLEELREAKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 14019 - protein, 72 aa, Homo sapiens
  Payload ID: 2725
  Gene Symbol: CEP162
  Gene Name: centrosomal protein 162kDa
  ENSP ID: ENSP00000410813
MANCSQEELDEEFEQFMKELSDDSFENSDKTARQSKKEMKKKDTVPWWITEDDFKDDGIIMKRQDVIPVSRV

SEQ ID NO: 14020 - protein, 1327 aa, Homo sapiens; identical to SEQ ID NO: 14017
  Payload ID: 2725
  Gene Symbol: CEP162
  Gene Name: centrosomal protein 162kDa
  Uniprot ID: Q5TB80
  ENSP ID: ENSP00000481760

SEQ ID NO: 14021 - protein, 1460 aa, Homo sapiens
  Payload ID: 2726
  Gene Symbol: CEP164
  Gene Name: centrosomal protein 164kDa
  Uniprot ID: Q9UPV0
  ENSP ID: ENSP00000278935
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVSLGSSVESGRQLGELMLPSQGLKTSAYTKGLLGSIYEDKTALSLLGLGEETNEEDEEESDNQSVHSSSEPLRNLHLDIGALGGDFEYEESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERLSPPLPHEERAQSPPRSLATEEEPPQGPEGQPEWKEAEELGEDSAASLSLQLSLQREQAPSPPAACEKGKEQHSQAEELGPGQEEAEDPEEKVAVSPTPPVSPEVRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVQQTRSMRRRQTALKAAQQHWRHELASAQEVAKDPPGIKALEDMRKNLEKETRHLDEMKSAMRKGHNLLKKKEEKLNQLESSLWEEASDEGTLGGSPTKKAVTFDLSDMDSLSSESSESFSPPHREWWRQQRIDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 14022 - protein, 121 aa, Homo sapiens
  Payload ID: 2726
  Gene Symbol: CEP164
  Gene Name: centrosomal protein 164kDa
  ENSP ID: ENSP00000431302
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDK

SEQ ID NO: 14023 - protein, 122 aa, Homo sapiens
  Payload ID: 2726
  Gene Symbol: CEP164
  Gene Name: centrosomal protein 164kDa
  ENSP ID: ENSP00000435759
MWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVS

SEQ ID NO: 14024 - protein, 158 aa, Homo sapiens
  Payload ID: 2726
  Gene Symbol: CEP164
  Gene Name: centrosomal protein 164kDa
  ENSP ID: ENSP00000436034
MWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVSLGSSVESGRQLGELMLPSQGLKTSAYTKGLLGSIYE

SEQ ID NO: 14025 - protein, 121 aa, Homo sapiens; identical to SEQ ID NO: 14022
  Payload ID: 2726
  Gene Symbol: CEP164
  Gene Name: centrosomal protein 164kDa
  ENSP ID: ENSP00000436351

SEQ ID NO: 14026 - protein, 115 aa, Homo sapiens
  Payload ID: 2726
  Gene Symbol: CEP164
  Gene Name: centrosomal protein 164kDa
  ENSP ID: ENSP00000436609
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKK

SEQ ID NO: 14027 - protein, 1554 aa, Homo sapiens
  Payload ID: 2727
  Gene Symbol: CEP170B
  Gene Name: centrosomal protein 170B
  Uniprot ID: Q9Y4F5
  ENSP ID: ENSP00000404151
MSATSWFLVSSSGARHRLPRELIFVGREECELMLQSRSVDKQHAVINYDQDRDEHWVKDLGSLNGTFVNDMRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSTTQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 14028 - protein, 1590 aa, Homo sapiens [sequence omitted]

SEQ ID NO: 14029 - protein, 1519 aa, Homo sapiens
  Payload ID: 2727
  Gene Symbol: CEP170B
  Gene Name: centrosomal protein 170B
  Uniprot ID: Q9Y4F5
  ENSP ID: ENSP00000451249
MRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSNTRRRQQGSDYTSTSEEEYGSRHGSPKHTRSHTSTATQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 14030 - protein, 1558 aa, Homo sapiens
  Payload ID: 2728
  Gene Symbol: CEP170
  Gene Name: centrosomal protein 170kDa
  ENSP ID: ENSP00000338161
  MOD_RES (1)..(1): Any amino acid
XQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVSQTAFMIAFFDEDNPRKRRSYSFTQSAGILCQETTYSTPHTKLEKAKSPTADAKVVSLSLQTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 14031 - protein, 1584 aa, Homo sapiens
  Payload ID: 2728
  Gene Symbol: CEP170
  Gene Name: centrosomal protein 170kDa
  Uniprot ID: Q5SW79
  ENSP ID: ENSP00000355500
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 14032 - protein, 1460 aa, Homo sapiens
  Payload ID: 2728
  Gene Symbol: CEP170
  Gene Name: centrosomal protein 170kDa
  Uniprot ID: Q5SW79
  ENSP ID: ENSP00000355501
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 14033 - protein, 1486 aa, Homo sapiens
  Payload ID: 2728
  Gene Symbol: CEP170
  Gene Name: centrosomal protein 170kDa
  Uniprot ID: Q5SW79
  ENSP ID: ENSP00000355502
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 14034 - protein, 263 aa, Homo sapiens
  Payload ID: 2728
  Gene Symbol: CEP170
  Gene Name: centrosomal protein 170kDa
  ENSP ID: ENSP00000394002
TRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSM

SEQ ID NO: 14035 - protein, 320 aa, Homo sapiens
  Payload ID: 2728
  Gene Symbol: CEP170
  Gene Name: centrosomal protein 170kDa
  ENSP ID: ENSP00000427842
MPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 14036 - protein, 175 aa, Homo sapiens
  Payload ID: 2728
  Gene Symbol: CEP170
  Gene Name: centrosomal protein 170kDa
  ENSP ID: ENSP00000427843
MPTSSSFKHRIKEQEDYIRDWTAHREEIARISQDLALIAREINDVAGEIDSVTSSGTAPSTTLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIV

SEQ ID NO: 14037 - protein, 133 aa, Homo sapiens
  Payload ID: 2728
  Gene Symbol: CEP170
  Gene Name: centrosomal protein 170kDa
  ENSP ID: ENSP00000427944
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKS

SEQ ID NO: 14038 - protein, 111 aa, Homo sapiens
  Payload ID: 2728
  Gene Symbol: CEP170
  Gene Name: centrosomal protein 170kDa
  ENSP ID: ENSP00000428183
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALK

SEQ ID NO: 14039 - protein, 88 aa, Homo sapiens
  Payload ID: 2728
  Gene Symbol: CEP170
  Gene Name: centrosomal protein 170kDa
  ENSP ID: ENSP00000428400
MSLTSWFLVSSGGTRHRLPREMIFVGRDDCELMLQSRSVDKQHAVINYDASTDEHLVKDLGSLNGTFVNDVRIPEQTYITLKLEDKLR

SEQ ID NO: 14040 - protein, 119 aa, Homo sapiens
  Payload ID: 2728
  Gene Symbol: CEP170
  Gene Name: centrosomal protein 170kDa
  ENSP ID: ENSP00000428777
  MOD_RES (1)..(1): Any amino acid
XKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVTASSFYKLLYQT

SEQ ID NO: 14041 - protein, 173 aa, Homo sapiens
  Payload ID: 2728
  Gene Symbol: CEP170
  Gene Name: centrosomal protein 170kDa
  ENSP ID: ENSP00000428996
  MOD_RES (1)..(1): Any amino acid
XDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENGILFLSFILYPFFLLFLHFSLFLLLFSAFL

SEQ ID NO: 14042 - protein, 103 aa, Homo sapiens
  Payload ID: 2728
  Gene Symbol: CEP170
  Gene Name: centrosomal protein 170kDa
  ENSP ID: ENSP00000430112
MPTSSSFKHRIKEQEDYIRDWTAHREEIARISQDLALIAREINDVAGEIDSVTSSGTAPSTTLVDRVFDESLNFRKIPPLVHSKTPEGNNGRSGDPRPQAAEP

SEQ ID NO: 14043 - protein, 293 aa, Homo sapiens
  Payload ID: 2728
  Gene Symbol: CEP170
  Gene Name: centrosomal protein 170kDa
  ENSP ID: ENSP00000430142
MPTSSSFKHRIKEQEDYIRDWTAHREEIARISQDLALIAREINDVAGEIDSVTSSGTAPSTTLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 14044 - protein, 1486 aa, Homo sapiens; identical to SEQ ID NO: 14033
  Payload ID: 2728
  Gene Symbol: CEP170
  Gene Name: centrosomal protein 170kDa
  Uniprot ID: Q5SW79
  ENSP ID: ENSP00000482707

SEQ ID NO: 14045 - protein, 1584 aa, Homo sapiens; identical to SEQ ID NO: 14031
  Payload ID: 2728
  Gene Symbol: CEP170
  Gene Name: centrosomal protein 170kDa
  Uniprot ID: Q5SW79
  ENSP ID: ENSP00000483344

SEQ ID NO: 14046 - protein, 1460 aa, Homo sapiens; identical to SEQ ID NO: 14032
  Payload ID: 2728
  Gene Symbol: CEP170
  Gene Name: centrosomal protein 170kDa
  Uniprot ID: Q5SW79
  ENSP ID: ENSP00000484359

SEQ ID NO: 14047 - protein, 2062 aa, Homo sapiens
  Payload ID: 2729
  Gene Symbol: CEP192
  Gene Name: centrosomal protein 192kDa
  ENSP ID: ENSP00000317156
MDGCLDTETPTVSIQENVDVASLKPISDSGINFTDAIWSPTCERRTCECHESIEKNKDKTDLPQSVVYQNEEGRWVTDLAYYTSFNSKQNLNVSLSDEMNEDFRSGSEAFDLIAQDEEEFNKEHQFIQPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 14048 - protein, 426 aa, Homo sapiens [sequence omitted]

SEQ ID NO: 14049 - protein, 1931 aa, Homo sapiens
  Payload ID: 2729
  Gene Symbol: CEP192
  Gene Name: centrosomal protein 192kDa
  ENSP ID: ENSP00000423147
KTVLHMDGCLDTETPTVSIQENVDVASLKPISDSGINFTDAIWSPTCERRTCECHESIEKNKDKTDLPQSVVYQNEEGRWVTDLAYYTSFNSKQNLNVSLSDEMNEDFRSGSEAFDLIAQDEEEFNKEHQFIQEENIDAHNTSVALGDTSWGATINYSLLRKSRSTSDLDKDDASYLRLSLGEFFAQRSEALGCLGGGNNVKRPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKRWSLTTLPRLVSIS

SEQ ID NO: 14050 - protein, 407 aa, Homo sapiens
  Payload ID: 2729
  Gene Symbol: CEP192
  Gene Name: centrosomal protein 192kDa
  ENSP ID: ENSP00000424671
  MOD_RES (1)..(1): Any amino acid
XNALSKQSALQMETAGPEEEPAGATESLQGQDLFNRASPLEQAQDSPIDFHLQSWMNNKEPKIVVLDAGKHFEDKTLKSDLSHTSLLENEKLILPTSLEDSSDDDIDDEMFYDDHLEAYFEQLAIPGMIYEDLEGPEPPEKGFKLPTNGLRQANENGSLNCKFQSENNSSLISLDSHSSETTHKESEESQVICLPGTSNSIGTGDSRRYTDGMLPFSSGTWGTEKEIENLKGIVPDLNSECASKDVLVKTLRAIDVKLNSDNFHDANANRGGFDLTDPVKQGAECPHQNKTVLHMDGCLDTETPTVSIQENVDVASLKPISDSGINFTDAIWSPTCERRTCECHESIEKNKDKTDLPQSVVYQNEEGRWVTDLAYYTSFNSKQNLNVSLSDEMNEDFRSGSIIWLFY

SEQ ID NO: 14051 - protein, 2537 aa, Homo sapiens
  Payload ID: 2729
  Gene Symbol: CEP192
  Gene Name: centrosomal protein 192kDa
  Uniprot ID: Q8TEP8
  ENSP ID: ENSP00000427550
MEDFRGIAEESFPSFLTNSLFGNSGILENVTLSSNLGLPVAVSTLARDRSSTDNRYPDIQASYLVEGRFSVPSGSSPGSQSDAEPRERLQLSFQDDDSISRKKSYVESQRLSNALSKQSALQMETAGPEEEPAGATESLQGQDLFNRASPLEQAQDSPIDFHLQSWMNNKEPKIVVLDAGKHFEDKTLKSDLSHTSLLENEKLILPTSLEDSSDDDIDDEMFYDDHLEAYFEQLAIPGMIYEDLEGPEPPEKGFKLPTNGLRQANENGSLNCKFQSENNSSLISLDSHSSETTHKESEESQVICLPGTSNSIGTGDSRRYTDGMLPFSSGTWGTEKEIENLKGIVPDLNSECASKDVLVKTLRAIDVKLNSDNFHDANANRGGFDLTDPVKQGAECPHQNKTVLHMDGCLDTETPTVSIQENVDVASLKPISDSGINFTDAIWSPTCERRTCECHESIEKNKDKTDLPQSVVYQNEEGRWVTDLAYYTSFNSKQNLNVSLSDEMNEDFRSGSEAFDLIAQDEEEFNKEHQFIQEENIDAHNTSVALGDTSWGATINYSLLRKSRSTSDLDKDDASYLRLSLGEFFAQRSEALGCLGGGNNVKRPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 14052 - protein, 1237 aa, Homo sapiens
  Payload ID: 2729
  Gene Symbol: CEP192
  Gene Name: centrosomal protein 192kDa
  ENSP ID: ENSP00000466258
MEDFRGIAEESFPSFLTNSLFGNSGILENVTLSSNLGLPVAVSTLARDRSSTDNRYPDIQASYLVEGRFSVPSGSSPGSQSDAEPRERLQLSFQDDDSISRKKSYVESQRLSNALSKQSALQMETAGPEEEPAGATESLQGQDLFNRASPLEQAQDSPIDFHLQSWMNNKEPKIVVLDAGKHFEDKTLKSDLSHTSLLENEKLILPTSLEDSSDDDIDDEMFYDDHLEAYFEQLAIPGMIYEDLEGPEPPEKGFKLPTNGLRQANENGSLNCKFQSENNSSLISLDSHSSETTHKESEESQVICLPGTSNSIGTGDSRRYTDGEFFAQRSEALGCLGGGNNVKRPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIE

SEQ ID NO: 14053 - protein, 2076 aa, Homo sapiens
  Payload ID: 2729
  Gene Symbol: CEP192
  Gene Name: centrosomal protein 192kDa
  ENSP ID: ENSP00000467038
  MOD_RES (1)..(1): Any amino acid
XGAECPHQNKTVLHMDGCLDTETPTVSIQENVDVASLKPISDSGINFTDAIWSPTCERRTCECHESIEKNKDKTDLPQSVVYQNEEGRWVTDLAYYTSFNSKQNLNVSLSDEMNEDFRSGSEAFDLIAQDEEEFNKEHQFIQPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 14054 - protein, 900 aa, Homo sapiens
  Payload ID: 2729
  Gene Symbol: CEP192
  Gene Name: centrosomal protein 192kDa
  ENSP ID: ENSP00000467297
  MOD_RES (1)..(1): Any amino acid
XGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKQAA

SEQ ID NO: 14055 - protein, 47 aa, Homo sapiens
  Payload ID: 2729
  Gene Symbol: CEP192
  Gene Name: centrosomal protein 192kDa
  ENSP ID: ENSP00000468047
NTGSRAAFVKAVGFKDSQKKVLLDPKVLRIFPDKFVLKERTQEGPVT

SEQ ID NO: 14056 - protein, 73 aa, Homo sapiens
  Payload ID: 2729
  Gene Symbol: CEP192
  Gene Name: centrosomal protein 192kDa
  ENSP ID: ENSP00000468242
  MOD_RES (1)..(1): Any amino acid
XPVPSVGTNCGIEPWDSGVTSGLGSVRVPEELKLPHACCVGIASQTLLSVLNPTDRWLQVSIGVLSISVNGEK

SEQ ID NO: 14057 - protein, 70 aa, Homo sapiens
  Payload ID: 2729
  Gene Symbol: CEP192
  Gene Name: centrosomal protein 192kDa
  ENSP ID: ENSP00000476907
MEDFRGIAEESFPSFLTNSLFGNSGILENVTLSSNLGLPVAVSTLARDRSSTDNRIWQHRFSKDIYELHF

SEQ ID NO: 14058 - protein, 128 aa, Homo sapiens
  Payload ID: 2730
  Gene Symbol: CEP19
  Gene Name: centrosomal protein 19kDa
  ENSP ID: ENSP00000382823
MSFLYSSKDCTRAAEQLKNNPRHKSYLEQVSLRQLEKLFSFLRGYLSGQSLAETMEQIQRETTIDPEEDLNKLDDKELAKRKSIMDELFEKNQKKKDDPNFVYDIEVEFPQDDQLQSCGWDTESADEF

SEQ ID NO: 14059 - protein, 167 aa, Homo sapiens
  Payload ID: 2730
  Gene Symbol: CEP19
  Gene Name: centrosomal protein 19kDa
  Uniprot ID: Q96LK0
  ENSP ID: ENSP00000387209
MYMGMMCTAKKCGIRFQPPAIILIYESEIKGKIRQRIMPVRNFSKFSDCTRAAEQLKNNPRHKSYLEQVSLRQLEKLFSFLRGYLSGQSLAETMEQIQRETTIDPEEDLNKLDDKELAKRKSIMDELFEKNQKKKDDPNFVYDIEVEFPQDDQLQSCGWDTESADEF

SEQ ID NO: 14060 - protein, 339 aa, Homo sapiens
  Payload ID: 2731
  Gene Symbol: CEP250
  Gene Name: centrosomal protein 250kDa
  ENSP ID: ENSP00000380658
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILVHDPLLWKGVGRGLVGSLCFMDR

SEQ ID NO: 14061 - protein, 2442 aa, Homo sapiens
  Payload ID: 2731
  Gene Symbol: CEP250
  Gene Name: centrosomal protein 250kDa
  Uniprot ID: Q9BV73
  ENSP ID: ENSP00000380661
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 14062 - protein, 138 aa, Homo sapiens
  Payload ID: 2731
  Gene Symbol: CEP250
  Gene Name: centrosomal protein 250kDa
  ENSP ID: ENSP00000394346
ITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRRNLSGKESRTP

SEQ ID NO: 14063 - protein, 877 aa, Homo sapiens
  Payload ID: 2731
  Gene Symbol: CEP250
  Gene Name: centrosomal protein 250kDa
  ENSP ID: ENSP00000395992
LEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 14064 - protein, 164 aa, Homo sapiens
  Payload ID: 2731
  Gene Symbol: CEP250
  Gene Name: centrosomal protein 250kDa
  ENSP ID: ENSP00000398747
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQE

SEQ ID NO: 14065 - protein, 210 aa, Homo sapiens
  Payload ID: 2731
  Gene Symbol: CEP250
  Gene Name: centrosomal protein 250kDa
  ENSP ID: ENSP00000400200
  MOD_RES (1)..(1): Any amino acid
XGGTAGGAAPGCPGEGASGCWEDESNVLENASIEPGICQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKL

SEQ ID NO: 14066 - protein, 684 aa, Homo sapiens
  Payload ID: 2731
  Gene Symbol: CEP250
  Gene Name: centrosomal protein 250kDa
  ENSP ID: ENSP00000413827
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILTNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDI

SEQ ID NO: 14067 - protein, 114 aa, Homo sapiens
  Payload ID: 2731
  Gene Symbol: CEP250
  Gene Name: centrosomal protein 250kDa
  ENSP ID: ENSP00000414651
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLA

SEQ ID NO: 14068 - protein, 538 aa, Homo sapiens
  Payload ID: 2731
  Gene Symbol: CEP250
  Gene Name: centrosomal protein 250kDa
  ENSP ID: ENSP00000419137
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQSSQLQSCRVLKTP

SEQ ID NO: 14069 - protein, 34 aa, Homo sapiens
  Payload ID: 2731
  Gene Symbol: CEP250
  Gene Name: centrosomal protein 250kDa
  ENSP ID: ENSP00000482323
DGRGQKNSDAKCVAELQKEGRAHGKWHADSDTGH

SEQ ID NO: 14070 - protein, 2481 aa, Homo sapiens
  Payload ID: 2732
  Gene Symbol: CEP290
  Gene Name: centrosomal protein 290kDa
  ENSP ID: ENSP00000308021
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEASIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKKLKNLEDSLEDYNRKFAVIRHQQSLLYKEYLSEKETWKTESKTIKEEKRKLEDQVQQDAIKVKEYNNLLNALQMDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 14071 - protein, 806 aa, Homo sapiens
  Payload ID: 2732
  Gene Symbol: CEP290
  Gene Name: centrosomal protein 290kDa
  ENSP ID: ENSP00000380938
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEASIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKVKEFRRFS

SEQ ID NO: 14072 - protein, 1539 aa, Homo sapiens
  Payload ID: 2732
  Gene Symbol: CEP290
  Gene Name: centrosomal protein 290kDa
  Uniprot ID: O15078
  ENSP ID: ENSP00000446905
MAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 14073 - protein, 107 aa, Homo sapiens
  Payload ID: 2732
  Gene Symbol: CEP290
  Gene Name: centrosomal protein 290kDa
  ENSP ID: ENSP00000447527
VIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQVKHFFFP

SEQ ID NO: 14074 - protein, 164 aa, Homo sapiens
  Payload ID: 2732
  Gene Symbol: CEP290
  Gene Name: centrosomal protein 290kDa
  ENSP ID: ENSP00000447623
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQNKRLKKKNEQLCQDIID

SEQ ID NO: 14075 - protein, 2479 aa, Homo sapiens
  Payload ID: 2732
  Gene Symbol: CEP290
  Gene Name: centrosomal protein 290kDa
  Uniprot ID: O15078
  ENSP ID: ENSP00000448012
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKKLKNLEDSLEDYNRKFAVIRHQQSLLYKEYLSEKETWKTESKTIKEEKRKLEDQVQQDAIKVKEYNNLLNALQMDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 14076 - protein, 613 aa, Homo sapiens
  Payload ID: 2732
  Gene Symbol: CEP290
  Gene Name: centrosomal protein 290kDa
  ENSP ID: ENSP00000448573
VEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEFLSRELIEKERDLERSRTVIAKFQNKCYRIKECRRNL

SEQ ID NO: 14077 - protein, 857 aa, Homo sapiens
  Payload ID: 2732
  Gene Symbol: CEP290
  Gene Name: centrosomal protein 290kDa
  ENSP ID: ENSP00000473863
DHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEIIAQEFLIKEAECRNADIELEHHRSQAEQNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKKLKNLEDSLEDYNRKFAVIRHQQSLLYKEYLSEKETWKTESKTIKEEKRKLEDQVQQDAIKVKEYNNLLNALQMDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAEV

SEQ ID NO: 14078 - protein, 2601 aa, Homo sapiens
  Payload ID: 2733
  Gene Symbol: CEP295
  Gene Name: centrosomal protein 295kDa
  Uniprot ID: Q9C0D2
  ENSP ID: ENSP00000316681
MKRKVVNTHKLRLSPNEEAFILKEDYERRRKLRLLQVREQERDIALQIREDIKQRRNQQFTRLAEELRAEWEESQTQKIQNLEKLYLASLRSMGEGHRQAKENEPDLDALAQRAAERKRKADLRHKEALKVQKNQKEILLKQKTWHIKARKEALLVEKERSAKITSLPPPPPTLFENIEVKRISAVKTNSSTYHHLHTFVNRETDTKRPDARLAAEEEAKRLEELQKQAAQERMERFEKAHVRGFQAMKKIHLAQNQEKLMKELKQLQQEDLARRRQTVAQMPPQLVELPYKRSEMKEDWQRELEFAFEDMYNADRKVKGNLILHLEPEPLPTVTNQIQDEELDLSMEQENLGAAEDLPVTEAEICSSETDVPLVMKTQQIPSKVLFKKLLNKIRSQKSLWTIKSMSEDESEMITTVSEIESKAPTVESGTIASKERTLSSGQEQVVESDTLTIESGPLASEDKPLSCGTNSGKEQEINETLPITTVAQSSVLLHPQEAAARIRMSARQKQIMEIEEQKQKQLELLEQIEQQKLRLETDCFRAQLEEEKRKKTQPTGVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQVETTETLRASDILTNQALESQEHLRQFSQTETQQRDYKLVPKDSETLSRALSHDRQLISQDARKISETFGATTFQSLESQQLFSENSENISYHLTEPSSFVPLVPQHSFSSLPVKVESGKIQEPFSAMSKSTVSTSHSIISQMHDRPLLPSENITAQQGNMKALQEQLDLQKKVLQATQEAQEQLLLCKQKEVEQQTGLSVFLPLVTPDSSALLPSAKADLGRIQESSPTKNNIAVSSDHHVISQLQDKRLSLSQPILSQQNNFKFLQEQLNIQKDSLQARREAQEVLYVHKQSELDRRVCSEQAEPSFPFQVAQHTFTSLPSADTKSGKIQEQHSSKSEKGLVSCQSDIPISQDGSLSFLQQFLPLHDSLKLLQEQLTKQRDTLQARHEAQVELLLHRQRDLGDSKSGLVSSSSSPVVVQHSVASQASAKAEPRRIQELYLSEKENVGPSCHLIIPTFQDKSLSFPQHSLAQQENLTILQEQSQIQRVILGAKEGTQEFVHTESELEKRISSEQTGTSSSLSQVDESERFQECISIKSDSTIPLSHPKIPRCQERLLRVSQHMLPLQDNLEEHQAWLDTEKEAFHFSQKTQENTSSEQTGSSSFIPQLVQLSFTSLASAESGTILEPLFTESESKIFSSHLQIPQLQDRLLRISQLIQPQQDNLKALQEQLATQREAIILARQEAREELLLHQSEWEGRISPEQVDTSSLPLVPQHSFASLPLNESERNQEPCSINSDNIVSSGHSEIPTLPDGLLGLSHLVLPQQDNLIALEEHLHAQTDFLPSIEKTQKELVLSKPCKFEEKVSSEHFIQSHHGDLQALQQQLDTQKKAIRSIQEVQEELLLQRLSELEKRVSSEQVCSSSFVSQVPVADSERTQKSFPTKSNDTLPSSHREIPRLQDRLLSLSKPILPQQDNMTAQLDAQREVMYSYEKPQEELSLNKQRKLNKSESAEHTIPSLFLPKETEHSFIPLPFAEAKPKSTCELYSSQNEHAAPPSNPVIPGFQDRLLSFSQSVLTQQDNLGLQKQLDLQREVLHYSQKAQEKLLVQRQTALQQQIQKHEETLKDFFKDSQISKPTVENDLKTQKMGQLRDWFPNTQDLAGNDQENIRHADRNNSDDNHLASEDTSAKQSGEHLEKDLGRRSSKPPVAKVKCGLDLNQHELSAIQEVESPAIGRTSILGKPGIYEDRDPLRVSISREQSFFGSPLAHDPFSCLQLVGQENVCGDDYDEAVKLKESVVENHAVLSYAVEEEHAYLGPTVKPDDKAKTLSYEPLSSATVSTGSLLSYENTDLSLTDPESFSEHMDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKKTLEKLRAKNTC

SEQ ID NO: 14079 - protein, 138 aa, Homo sapiens
  Payload ID: 2733
  Gene Symbol: CEP295
  Gene Name: centrosomal protein 295kDa
  ENSP ID: ENSP00000431853
MGQLRDWFPNTQDLAGNDQENIRHADRNNSDDNHLASEDTSAKQSGKPGIYEDRDPLRVSISREQSFFGSPLAHDPFSCLQLVGQENVCGDDYDEAVKLKESVVENHAVLSYAVEEEHAYLGPTVKPDDKSHFQSTWM

SEQ ID NO: 14080 - protein, 79 aa, Homo sapiens
  Payload ID: 2733
  Gene Symbol: CEP295
  Gene Name: centrosomal protein 295kDa
  ENSP ID: ENSP00000433198
MHSSLNTSPNQQPDTNLAHVGAHSFATENIIGGSEQCFEQLQPEYSSQEESQHADLPSIFSIEARDSSQGMKNQNYPSE

SEQ ID NO: 14081 - protein, 579 aa, Homo sapiens
  Payload ID: 2733
  Gene Symbol: CEP295
  Gene Name: centrosomal protein 295kDa
  ENSP ID: ENSP00000433650
MDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTAETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQ

SEQ ID NO: 14082 - protein, 248 aa, Homo sapiens
  Payload ID: 2733
  Gene Symbol: CEP295
  Gene Name: centrosomal protein 295kDa
  ENSP ID: ENSP00000433794
  MOD_RES (1)..(1): Any amino acid
XIESGPLASEDKPLSCGTNSGKEQEINETLPITTVAQSSVLLHPQEAAARIRMSARQKQIMEIEEQKQKQLELLEQIEQQKLRLETDCFRAQLEEEKRKKTQPTGVGCRKSHHYINHLVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQV

SEQ ID NO: 14083 - protein, 781 aa, Homo sapiens
  Payload ID: 2733
  Gene Symbol: CEP295
  Gene Name: centrosomal protein 295kDa
  Uniprot ID: Q9C0D2
  ENSP ID: ENSP00000437323
MGQLRDWFPNTQDLAGNDQENIRHADRNNSDDNHLASEDTSAKQSGKPGIYEDRDPLRVSISREQSFFGSPLAHDPFSCLQLVGQENVCGDDYDEAVKLKESVVENHAVLSYAVEEEHAYLGPTVKPDDKAKTLSYEPLSSATVSTGSLLSYENTDLSLTDPESFSEHMDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKKTLEKLRAKNTC

SEQ ID NO: 14084 - protein, 130 aa, Homo sapiens
  Payload ID: 2734
  Gene Symbol: CEP350
  Gene Name: centrosomal protein 350kDa
  ENSP ID: ENSP00000350016
MRSSKSKEVPLPNPRNSQSKDTVQDITTSWDALSQTKAALRHIENKLEVAPTSTAVCDSVMDTKKSSTSATRKISRKDGRYLDDSWVNAPISKSTKSRKEKSRSPLRATTLESNVKKNNRVEFREPLVSY

SEQ ID NO: 14085 - protein, 3117 aa, Homo sapiens
  Payload ID: 2734
  Gene Symbol: CEP350
  Gene Name: centrosomal protein 350kDa
  Uniprot ID: Q5VT06
  ENSP ID: ENSP00000356579
MRSSKSKEVPLPNPRNSQSKDTVQADITTSWDALSQTKAALRHIENKLEVAPTSTAVCDSVMDTKKSSTSATRKISRKDGRYLDDSWVNAPISKSTKSRKEKSRSPLRATTLESNVKKNNRVEFREPLVSYREIHGAPSNFSSSHLESKHVYCVDVNEEKTESGNWMIGSREERNIRSCDFESSQSSVINDTVVRFLNDRPAIDALQNSECLIRMGASMRTEEEMPNRTKGSENNLKLSVNNMAHDTDPKALRLTDSSPSSTSTSNSQRLDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 14086 - protein, 581 aa, Homo sapiens
  Payload ID: 2734
  Gene Symbol: CEP350
  Gene Name: centrosomal protein 350kDa
  ENSP ID: ENSP00000401608
NNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 14087 - protein, 331 aa, Homo sapiens
  Payload ID: 2734
  Gene Symbol: CEP350
  Gene Name: centrosomal protein 350kDa
  ENSP ID: ENSP00000407044
  MOD_RES (1)..(1): Any amino acid
XESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKETGSCSVTQAGLELLASRDPPTLASQNAGITDSTSIATEYSLKFDESMTEDEIEEQSFRSLLPSESHRRFNMEKRRGHHDDSDEEASPEKTTLSTAKELNMPFSGGQDSFSKFTMEMVRQYMKEE

SEQ ID NO: 14088 - protein, 110 aa, Homo sapiens
  Payload ID: 2734
  Gene Symbol: CEP350
  Gene Name: centrosomal protein 350kDa
  ENSP ID: ENSP00000409395
SLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLEVRHRKKGV

SEQ ID NO: 14089 - protein, 1292 aa, Homo sapiens
  Payload ID: 2734
  Gene Symbol: CEP350
  Gene Name: centrosomal protein 350kDa
  ENSP ID: ENSP00000412460
  MOD_RES (1)..(1): Any amino acid
XFTSHHWASLSVCFPNLHPKFQLYIYNQLVRFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 14090 - protein, 57 aa, Homo sapiens
  Payload ID: 2734
  Gene Symbol: CEP350
  Gene Name: centrosomal protein 350kDa
  ENSP ID: ENSP00000432910
VHAESLQQVVQSQREVTEVLQEATCKIAAQQSETARLTTDAARQICEEKSICFTLSE

SEQ ID NO: 14091 - protein, 242 aa, Homo sapiens
  Payload ID: 2734
  Gene Symbol: CEP350
  Gene Name: centrosomal protein 350kDa
  ENSP ID: ENSP00000435808
MHRGSRGRRRHSQDEEQQIKRGAFTKSKELSKQGYCSRYNHIVGCTFSNQGCYGRYLDDSWVNAPISKSTKSRKEKSRSPLRATTLESNVKKNNRVEFREPLVSYREIHGAPSNFSSSHLESKHVYCVDVNEEKTESGNWMIGSREERNIRSCDFESSQSSVINDTVVRFLNDRPAIDALQNSECLIRMGASMRTEEEMPNRTKGSENNLKLSVNNMAHDTDPKALRLTDSSPSSTSTSNSQ

SEQ ID NO: 14092 - protein, 373 aa, Homo sapiens
  Payload ID: 2735
  Gene Symbol: CEP41
  Gene Name: centrosomal protein 41kDa
  Uniprot ID: Q9BYV8
  ENSP ID: ENSP00000223208
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWK

SEQ ID NO: 14093 - protein, 301 aa, Homo sapiens
  Payload ID: 2735
  Gene Symbol: CEP41
  Gene Name: centrosomal protein 41kDa
  Uniprot ID: Q9BYV8
  ENSP ID: ENSP00000342738
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGRLNQANSSGRESKVPGARSAQNLPGGGPASHSNPRSLSSGHLQGKPWK

SEQ ID NO: 14094 - protein, 69 aa, Homo sapiens
  Payload ID: 2735
  Gene Symbol: CEP41
  Gene Name: centrosomal protein 41kDa
  ENSP ID: ENSP00000417463
MSLRRHIGNPEYLMKRIPQNPRYQHIKSRLDTGRTVPVFPPSLVSSATKTLSSFISTHLTPNCNCDPPF

SEQ ID NO: 14095 - protein, 161 aa, Homo sapiens
  Payload ID: 2735
  Gene Symbol: CEP41
  Gene Name: centrosomal protein 41kDa
  ENSP ID: ENSP00000417593
MTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYP

SEQ ID NO: 14096 - protein, 54 aa, Homo sapiens
  Payload ID: 2735
  Gene Symbol: CEP41
  Gene Name: centrosomal protein 41kDa
  Uniprot ID: Q9BYV8
  ENSP ID: ENSP00000417815
MSLRRHIGNPEYLMKRIPQNPRYQHIKSRLDTGACVYLTSSPALPDCAMNGLCF

SEQ ID NO: 14097 - protein, 140 aa, Homo sapiens
  Payload ID: 2735
  Gene Symbol: CEP41
  Gene Name: centrosomal protein 41kDa
  ENSP ID: ENSP00000418363
MTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLL

SEQ ID NO: 14098 - protein, 65 aa, Homo sapiens
  Payload ID: 2735
  Gene Symbol: CEP41
  Gene Name: centrosomal protein 41kDa
  ENSP ID: ENSP00000418712
MKRIPQNPRYQHIKSRLDTGNSMTKYTEKLEEIKKNYRYKKDELFKRLKVTTFAQLIIQVASLSD

SEQ ID NO: 14099 - protein, 125 aa, Homo sapiens
  Payload ID: 2735
  Gene Symbol: CEP41
  Gene Name: centrosomal protein 41kDa
  ENSP ID: ENSP00000419078
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPVSSVVLGNWI

SEQ ID NO: 14100 - protein, 193 aa, Homo sapiens
  Payload ID: 2735
  Gene Symbol: CEP41
  Gene Name: centrosomal protein 41kDa
  ENSP ID: ENSP00000419192
MTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDD

SEQ ID NO: 14101 - protein, 181 aa, Homo sapiens
  Payload ID: 2735
  Gene Symbol: CEP41
  Gene Name: centrosomal protein 41kDa
  ENSP ID: ENSP00000420670
MVTHKVHQYLMKRIPQNPRYQHIKSRLDTGNSMTKYTEKLEEIKKNYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSY

SEQ ID NO: 14102 - protein, 285 aa, Homo sapiens
  Payload ID: 2735
  Gene Symbol: CEP41
  Gene Name: centrosomal protein 41kDa
  Uniprot ID: Q9BYV8
  ENSP ID: ENSP00000445888
MSLRRHIGNPEYLMKRIPQNPRYQHIKSRLDTDYRYKKDELFKRLKVTTFAQLIIQVASLSDQTLEVTAEEIQRLEDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGAYSYPIATLSRTMNPYSNDILEYKNAHGKIIILYDDDERLASQAATTMCERGFENLFMLSGGRLNQANSSGRESKVPGARSAQNLPGGGPASHSNPRSLSSGHLQGKPWK

SEQ ID NO: 14103 - protein, 54 aa, Homo sapiens; identical to SEQ ID NO: 14096
  Payload ID: 2735
  Gene Symbol: CEP41
  Gene Name: centrosomal protein 41kDa
  Uniprot ID: Q9BYV8
  ENSP ID: ENSP00000479252

SEQ ID NO: 14104 - protein, 390 aa, Homo sapiens
  Payload ID: 2736
  Gene Symbol: CEP44
  Gene Name: centrosomal protein 44kDa
  Uniprot ID: Q9C0F1
  ENSP ID: ENSP00000296519
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISSGKSEPPLGNEKISAEAVGVDISGRFMTSGKKKAVVIRHLYNEDNVDISEDTLSPITDVNEAVDVSDLNATEIKMPEVKVPEIKAEQQDVNVNPEITALQTMLAECQENLKKLTSIEKRLDCLEQKMKGKVMVDENTWTNLLSRVTLLETEMLLSKKNDEFIEFNEVSEDYASCSDMDLLNPHRKSEVERPASIPLSSGYSTASSDSTPRASTVNYCGLNEISEETTIQKMERMKKMFEETAELLKCPNHYL

SEQ ID NO: 14105 - protein, 390 aa, Homo sapiens; identical to SEQ ID NO: 14104
  Payload ID: 2736
  Gene Symbol: CEP44
  Gene Name: centrosomal protein 44kDa
  Uniprot ID: Q9C0F1
  ENSP ID: ENSP00000380009

SEQ ID NO: 14106 - protein, 399 aa, Homo sapiens
  Payload ID: 2736
  Gene Symbol: CEP44
  Gene Name: centrosomal protein 44kDa
  Uniprot ID: Q9C0F1
  ENSP ID: ENSP00000389427
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISSGKSEPPLGNEKISAEAVGVDISGRFMTSGKKKAVVIRHLYNEDNVDISEDTLSPITDVNEAVDVSDLNATEIKMPEVKVPEIKAEQQDVNVNPEITALQTMLAECQENLKKLTSIEKRLDCLEQKMKGKVMVDENTWTNLLSRVTLLETEMLLSKKNDEFIEFNEVSEDYASCSDMDLLNPHRKSEVERPASIPLSSGYSTASSDSTPRASTVNYCGLNEISENFPAWSATSSCSSLSWLLRGHTSYLSSQSFAWPLSCV

SEQ ID NO: 14107 - protein, 399 aa, Homo sapiens; identical to SEQ ID NO: 14106
  Payload ID: 2736
  Gene Symbol: CEP44
  Gene Name: centrosomal protein 44kDa
  Uniprot ID: Q9C0F1
  ENSP ID: ENSP00000408221

SEQ ID NO: 14108 - protein, 198 aa, Homo sapiens
  Payload ID: 2736
  Gene Symbol: CEP44
  Gene Name: centrosomal protein 44kDa
  ENSP ID: ENSP00000421128
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISSGKSEPPLGNEKISAEAVGVDISGRFMTSGKKKAVVIRHLYNEDNVDISEDTLSPITDVN

SEQ ID NO: 14109 - protein, 390 aa, Homo sapiens; identical to SEQ ID NO: 14104
  Payload ID: 2736
  Gene Symbol: CEP44
  Gene Name: centrosomal protein 44kDa
  Uniprot ID: Q9C0F1
  ENSP ID: ENSP00000423153

SEQ ID NO: 14110 - protein, 139 aa, Homo sapiens
  Payload ID: 2736
  Gene Symbol: CEP44
  Gene Name: centrosomal protein 44kDa
  ENSP ID: ENSP00000423922
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISS

SEQ ID NO: 14111 - protein, 112 aa, Homo sapiens
  Payload ID: 2736
  Gene Symbol: CEP44
  Gene Name: centrosomal protein 44kDa
  ENSP ID: ENSP00000423949
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDI

SEQ ID NO: 14112 - protein, 112 aa, Homo sapiens; identical to SEQ ID NO: 14111
  Payload ID: 2736
  Gene Symbol: CEP44
  Gene Name: centrosomal protein 44kDa
  ENSP ID: ENSP00000427337

SEQ ID NO: 14113 - protein, 464 aa, Homo sapiens
  Payload ID: 2737
  Gene Symbol: CEP55
  Gene Name: centrosomal protein 55kDa
  Uniprot ID: Q53EZ4
  ENSP ID: ENSP00000360540
MSSRSTKDLIKSKWGSKPSNSKSETTLEKLKGEIAHLKTSVDEITSGKGKLTDKERHRLLEKIRVLEAEKEKNAYQLTEKDKEIQRLRDQLKARYSTTTLLEQLEETTREGERREQVLKALSEEKDVLKQQLSAATSRIAELESKTNTLRLSQTVAPNCFNSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQMQACTLDFENEKLDRQHVQHQLHVILKELRKARNQITQLESLKQLHEFAITEPLVTFQGETENREKVAASPKSPTAALNESLVECPKCNIQYPATEHRDLLVHVEYCSK

SEQ ID NO: 14114 - protein, 208 aa, Homo sapiens
  Payload ID: 2737
  Gene Symbol: CEP55
  Gene Name: centrosomal protein 55kDa
  ENSP ID: ENSP00000389150
  MOD_RES (1)..(1): Any amino acid
XSSINNIHEMEIQLKDALEKNQQWLVYDQQREVYVKGLLAKIFELEKKTETAAHSLPQQTKKPESEGYLQEEKQKCYNDLLASAKKDLEVERQTITQLSFELSEFRRKYEETQKEVHNLNQLLYSQRRADVQHLEDDRHKTEKIQKLREENDIARGKLEEEKKRSEELLSQVQFLYTSLLKQQEEQTRVALLEQQVLIRVASKFNSAC

SEQ ID NO: 14115 - protein, 474 aa, Homo sapiens
  Payload ID: 2738
  Gene Symbol: CEP57
  Gene Name: centrosomal protein 57kDa
  Uniprot ID: Q86XR8
  ENSP ID: ENSP00000317487
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 14116 - protein, 500 aa, Homo sapiens
  Payload ID: 2738
  Gene Symbol: CEP57
  Gene Name: centrosomal protein 57kDa
  Uniprot ID: Q86XR8
  ENSP ID: ENSP00000317902
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 14117 - protein, 82 aa, Homo sapiens
  Payload ID: 2738
  Gene Symbol: CEP57
  Gene Name: centrosomal protein 57kDa
  ENSP ID: ENSP00000437422
MAAASVSAASGSHLSNSFAEPSRSNGSMVRHSSSPYVVYPSDKPFLNSDLRRSPSKPTLAYPESNSRASTFVFVFGSHIFCS

SEQ ID NO: 14118 - protein, 198 aa, Homo sapiens
  Payload ID: 2738
  Gene Symbol: CEP57
  Gene Name: centrosomal protein 57kDa
  ENSP ID: ENSP00000438065
MLTRIDNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAE

SEQ ID NO: 14119 - protein, 254 aa, Homo sapiens
  Payload ID: 2738
  Gene Symbol: CEP57
  Gene Name: centrosomal protein 57kDa
  ENSP ID: ENSP00000440256
  MOD_RES (1)..(1): Any amino acid
XLEKLDLLEQEYNKLTTMQALAEKKMQELEAKLHEEEQERKRMQAKAAELQTGLETNRLIFEDKATPCVPNARRIKKKKSKPPEKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKD

SEQ ID NO: 14120 - protein, 71 aa, Homo sapiens
  Payload ID: 2738
  Gene Symbol: CEP57
  Gene Name: centrosomal protein 57kDa
  ENSP ID: ENSP00000440996
MAAASVSAASGSHLSNSFAEPSRSNGSMVRHSSSPYVVYPSDKPFLNSDLRRSPSKPTLAYPESNSRESSR

SEQ ID NO: 14121 - protein, 473 aa, Homo sapiens
  Payload ID: 2738
  Gene Symbol: CEP57
  Gene Name: centrosomal protein 57kDa
  ENSP ID: ENSP00000441392
MVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 14122 - protein, 41 aa, Homo sapiens
  Payload ID: 2738
  Gene Symbol: CEP57
  Gene Name: centrosomal protein 57kDa
  ENSP ID: ENSP00000442481
MAAASVSAASGSHLSPYFLLLRIFKIRFDAWNLRGFRQKKV

SEQ ID NO: 14123 - protein, 491 aa, Homo sapiens
  Payload ID: 2738
  Gene Symbol: CEP57
  Gene Name: centrosomal protein 57kDa
  Uniprot ID: Q86XR8
  ENSP ID: ENSP00000443436
MLTRIDNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 14124 - protein, 52 aa, Homo sapiens
  Payload ID: 2738
  Gene Symbol: CEP57
  Gene Name: centrosomal protein 57kDa
  ENSP ID: ENSP00000443866
MAAASVSAASGSHLSTRGWALDYSSVVGHGICTVTQPVSFSRKKREKIVQQI

SEQ ID NO: 14125 - protein, 134 aa, Homo sapiens
  Payload ID: 2738
  Gene Symbol: CEP57
  Gene Name: centrosomal protein 57kDa
  ENSP ID: ENSP00000444749
THVQSQLEKLDLLEQEYNKLTTMQALAEKKMQELEAKLHEEEQERKRMQAKAAESTSPSHAVVANVQLVLHLMKQHSKALCNDRVINSIPLAKQVSSRGGKSKKLSVTPPSSNGINEELSEVLQTLQDEFGQMS

SEQ ID NO: 14126 - protein, 270 aa, Homo sapiens
  Payload ID: 2738
  Gene Symbol: CEP57
  Gene Name: centrosomal protein 57kDa
  Uniprot ID: Q86XR8
  ENSP ID: ENSP00000445706
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKV

SEQ ID NO: 14127 - protein, 205 aa, Homo sapiens
  Payload ID: 2738
  Gene Symbol: CEP57
  Gene Name: centrosomal protein 57kDa
  ENSP ID: ENSP00000445821
MVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAA

SEQ ID NO: 14128 - protein, 460 aa, Homo sapiens
  Payload ID: 2739
  Gene Symbol: CEP57L1
  Gene Name: centrosomal protein 57kDa-like 1
  Uniprot ID: Q8IYX8
  ENSP ID: ENSP00000352841
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 14129 - protein, 391 aa, Homo sapiens
  Payload ID: 2739
  Gene Symbol: CEP57L1
  Gene Name: centrosomal protein 57kDa-like 1
  Uniprot ID: Q8IYX8
  ENSP ID: ENSP00000357964
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVRRL

SEQ ID NO: 14130 - protein, 477 aa, Homo sapiens
  Payload ID: 2739
  Gene Symbol: CEP57L1
  Gene Name: centrosomal protein 57kDa-like 1
  ENSP ID: ENSP00000357966
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKSTSASCSVNASMQNFLQMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 14131 - protein, 251 aa, Homo sapiens
  Payload ID: 2739
  Gene Symbol: CEP57L1
  Gene Name: centrosomal protein 57kDa-like 1
  ENSP ID: ENSP00000383936
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKVCI

SEQ ID NO: 14132 - protein, 195 aa, Homo sapiens
  Payload ID: 2739
  Gene Symbol: CEP57L1
  Gene Name: centrosomal protein 57kDa-like 1
  ENSP ID: ENSP00000427771
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDK

SEQ ID NO: 14133 - protein, 460 aa, Homo sapiens; identical to SEQ ID NO: 14128
  Payload ID: 2739
  Gene Symbol: CEP57L1
  Gene Name: centrosomal protein 57kDa-like 1
  Uniprot ID: Q8IYX8
  ENSP ID: ENSP00000427844

SEQ ID NO: 14134 - protein, 407 aa, Homo sapiens
  Payload ID: 2739
  Gene Symbol: CEP57L1
  Gene Name: centrosomal protein 57kDa-like 1
  ENSP ID: ENSP00000428344
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASEKTKCIKRRPPWQICSKFGALPFVAEKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 14135 - protein, 113 aa, Homo sapiens
  Payload ID: 2739
  Gene Symbol: CEP57L1
  Gene Name: centrosomal protein 57kDa-like 1
  ENSP ID: ENSP00000428464
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKK

SEQ ID NO: 14136 - protein, 129 aa, Homo sapiens
  Payload ID: 2739
  Gene Symbol: CEP57L1
  Gene Name: centrosomal protein 57kDa-like 1
  ENSP ID: ENSP00000428668
MVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKDKCVREQLLGHVISTFLVL

SEQ ID NO: 14137 - protein, 172 aa, Homo sapiens
  Payload ID: 2739
  Gene Symbol: CEP57L1
  Gene Name: centrosomal protein 57kDa-like 1
  ENSP ID: ENSP00000428682
LQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVRRL

SEQ ID NO: 14138 - protein, 28 aa, Homo sapiens
  Payload ID: 2739
  Gene Symbol: CEP57L1
  Gene Name: centrosomal protein 57kDa-like 1
  ENSP ID: ENSP00000429402
MDSELMHSIVGSYHKPPERVFVPSFTQN

SEQ ID NO: 14139 - protein, 206 aa, Homo sapiens
  Payload ID: 2739
  Gene Symbol: CEP57L1
  Gene Name: centrosomal protein 57kDa-like 1
  ENSP ID: ENSP00000429812
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEE

SEQ ID NO: 14140 - protein, 166 aa, Homo sapiens
  Payload ID: 2739
  Gene Symbol: CEP57L1
  Gene Name: centrosomal protein 57kDa-like 1
  ENSP ID: ENSP00000429957
MVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKVRGDKMKIVVQKNSCFVMRQHRDPHILQKP

SEQ ID NO: 14141 - protein, 360 aa, Homo sapiens
  Payload ID: 2739
  Gene Symbol: CEP57L1
  Gene Name: centrosomal protein 57kDa-like 1
  ENSP ID: ENSP00000430011
MDSELMHSIVGSYHKPPERVFVPSFTQNEPSQNCHPANLEVTSPKILHSPNSQEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 14142 - protein, 102 aa, Homo sapiens
  Payload ID: 2739
  Gene Symbol: CEP57L1
  Gene Name: centrosomal protein 57kDa-like 1
  ENSP ID: ENSP00000430013
MVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHS

SEQ ID NO: 14143 - protein, 230 aa, Homo sapiens
  Payload ID: 2739
  Gene Symbol: CEP57L1
  Gene Name: centrosomal protein 57kDa-like 1
  ENSP ID: ENSP00000430265
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKII

SEQ ID NO: 14144 - protein, 53 aa, Homo sapiens
  Payload ID: 2739
  Gene Symbol: CEP57L1
  Gene Name: centrosomal protein 57kDa-like 1
  ENSP ID: ENSP00000430402
MDSELMHSIVGSYHKPPERVFVPSFTQNEPSQNCHPANLEVTSPKILHSPNSQ

SEQ ID NO: 14145 - protein, 463 aa, Homo sapiens
  Payload ID: 2739
  Gene Symbol: CEP57L1
  Gene Name: centrosomal protein 57kDa-like 1
  ENSP ID: ENSP00000430529
MKIMDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 14146 - protein, 235 aa, Homo sapiens
  Payload ID: 2739
  Gene Symbol: CEP57L1
  Gene Name: centrosomal protein 57kDa-like 1
  ENSP ID: ENSP00000430558
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKVCI

SEQ ID NO: 14147 - protein, 79 aa, Homo sapiens
  Payload ID: 2739
  Gene Symbol: CEP57L1
  Gene Name: centrosomal protein 57kDa-like 1
  ENSP ID: ENSP00000430565
MVLNVEREKNMILEQQAQLQREKEQDQMKLYAKLEKLDVLEKECFRLTTTQKTAEDKIKHLEEKLKEEEHQRKLFQDKA

SEQ ID NO: 14148 - protein, 251 aa, Homo sapiens; identical to SEQ ID NO: 14131
  Payload ID: 2739
  Gene Symbol: CEP57L1
  Gene Name: centrosomal protein 57kDa-like 1
  ENSP ID: ENSP00000430911

SEQ ID NO: 14149 - protein, 112 aa, Homo sapiens
  Payload ID: 2739
  Gene Symbol: CEP57L1
  Gene Name: centrosomal protein 57kDa-like 1
  ENSP ID: ENSP00000431113
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQK

SEQ ID NO: 14150 - protein, 495 aa, Homo sapiens
  Payload ID: 2740
  Gene Symbol: CEP63
  Gene Name: centrosomal protein 63kDa
  Uniprot ID: Q96MT8
  ENSP ID: ENSP00000328382
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 14151 - protein, 703 aa, Homo sapiens
  Payload ID: 2740
  Gene Symbol: CEP63
  Gene Name: centrosomal protein 63kDa
  Uniprot ID: Q96MT8
  ENSP ID: ENSP00000336524
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEAKEISLADLQENYIEALNKLVSENQQLQKDLMNTKSQLEISTQMCKKQNDRIFKPTHSRTTEFKNTEFKPTHGQHRHDGIKTEHYKTDLHSPRGQASDSINPMSRVLSPLSPQISPCSSTRSLTSYSLCKTHSLPSALDTNEANFSDTMSESMNDQEEFISSCSLPVSPLGSIATRFLEEEELRSHHILERLDAHIEELKRESEKTVRQFTALK

SEQ ID NO: 14152 - protein, 475 aa, Homo sapiens
  Payload ID: 2740
  Gene Symbol: CEP63
  Gene Name: centrosomal protein 63kDa
  Uniprot ID: Q96MT8
  ENSP ID: ENSP00000346432
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHERWGFTMLSSLVLNFGIQAIRQPQRPKVLELQV

SEQ ID NO: 14153 - protein, 541 aa, Homo sapiens
  Payload ID: 2740
  Gene Symbol: CEP63
  Gene Name: centrosomal protein 63kDa
  Uniprot ID: Q96MT8
  ENSP ID: ENSP00000372716
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 14154 - protein, 155 aa, Homo sapiens
  Payload ID: 2740
  Gene Symbol: CEP63
  Gene Name: centrosomal protein 63kDa
  ENSP ID: ENSP00000422685
  MOD_RES (1)..(1): Any amino acid
XMLHQQVEEHEKIKQEMTMEYKQELKKLHEELCILKRSYEKLQKKQMREFRGNTKNHREDRSEIERLTAKIEEFRQKSLDWEKQRLIYQQQAQLVNRKQKLESVELSSQSEIQHLSSKLERANDTICANELEIERLTMRVNDLVGTSMTVLQEQQ

SEQ ID NO: 14155 - protein, 63 aa, Homo sapiens
  Payload ID: 2740
  Gene Symbol: CEP63
  Gene Name: centrosomal protein 63kDa
  ENSP ID: ENSP00000423225
MEALLEGIQNRGHGGGFLTSCEAELQELMKQIDIMVAHKKSEWEGRTHALETCLKIREQELKS

SEQ ID NO: 14156 - protein, 162 aa, Homo sapiens
  Payload ID: 2740
  Gene Symbol: CEP63
  Gene Name: centrosomal protein 63kDa
  ENSP ID: ENSP00000424626
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLI

SEQ ID NO: 14157 - protein, 703 aa, Homo sapiens; identical to SEQ ID NO: 14151
  Payload ID: 2740
  Gene Symbol: CEP63
  Gene Name: centrosomal protein 63kDa
  Uniprot ID: Q96MT8
  ENSP ID: ENSP00000426129

SEQ ID NO: 14158 - protein, 245 aa, Homo sapiens
  Payload ID: 2740
  Gene Symbol: CEP63
  Gene Name: centrosomal protein 63kDa
  ENSP ID: ENSP00000426866
  MOD_RES (1)..(1): Any amino acid
XEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEAKEISLADLQENYIEALNKLVSENQQLQKDLMNTKSQLEISTQMCKKQNDRIFKPTHSRTTEFKNTE

SEQ ID NO: 14159 - protein, 194 aa, Homo sapiens
  Payload ID: 2740
  Gene Symbol: CEP63
  Gene Name: centrosomal protein 63kDa
  ENSP ID: ENSP00000427526
DLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHERWGFTMLSSLVLNFGIQAIRQPQRPKVLELQV

SEQ ID NO: 14160 - protein, 703 aa, Homo sapiens; identical to SEQ ID NO: 14151
  Payload ID: 2740
  Gene Symbol: CEP63
  Gene Name: centrosomal protein 63kDa
  Uniprot ID: Q96MT8
  ENSP ID: ENSP00000475903

SEQ ID NO: 14161 - protein, 475 aa, Homo sapiens; identical to SEQ ID NO: 14152
  Payload ID: 2740
  Gene Symbol: CEP63
  Gene Name: centrosomal protein 63kDa
  Uniprot ID: Q96MT8
  ENSP ID: ENSP00000482219

SEQ ID NO: 14162 - protein, 620 aa, Homo sapiens
  Payload ID: 2741
  Gene Symbol: CEP68
  Gene Name: centrosomal protein 68kDa
  Uniprot ID: Q76N32
  ENSP ID: ENSP00000260569
MALGEEKAEAEASEDTKAQSYGRGSCRERELDIPGPMSGEQPPRLEAEGGLISPVWGAEGIPAPTCWIGTDPGGPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 14163 - protein, 757 aa, Homo sapiens
  Payload ID: 2741
  Gene Symbol: CEP68
  Gene Name: centrosomal protein 68kDa
  Uniprot ID: Q76N32
  ENSP ID: ENSP00000367229
MALGEEKAEAEASEDTKAQSYGRGSCRERELDIPGPMSGEQPPRLEAEGGLISPVWGAEGIPAPTCWIGTDPGGPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 14164 - protein, 294 aa, Homo sapiens
  Payload ID: 2741
  Gene Symbol: CEP68
  Gene Name: centrosomal protein 68kDa
  ENSP ID: ENSP00000443357
MGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKVMTLNVRKLCVQVSCLFPQSTNIIIKHVHVDQALFMCQALCCTLSYSVLTTFTR

SEQ ID NO: 14165 - protein, 597 aa, Homo sapiens
  Payload ID: 2742
  Gene Symbol: CEP70
  Gene Name: centrosomal protein 70kDa
  Uniprot ID: Q8NHQ1
  ENSP ID: ENSP00000264982
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 14166 - protein, 554 aa, Homo sapiens
  Payload ID: 2742
  Gene Symbol: CEP70
  Gene Name: centrosomal protein 70kDa
  Uniprot ID: Q8NHQ1
  ENSP ID: ENSP00000417465
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQRYLF

SEQ ID NO: 14167 - protein, 259 aa, Homo sapiens
  Payload ID: 2742
  Gene Symbol: CEP70
  Gene Name: centrosomal protein 70kDa
  ENSP ID: ENSP00000417819
MTEQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSE

SEQ ID NO: 14168 - protein, 445 aa, Homo sapiens
  Payload ID: 2742
  Gene Symbol: CEP70
  Gene Name: centrosomal protein 70kDa
  ENSP ID: ENSP00000417821
MTEVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 14169 - protein, 293 aa, Homo sapiens
  Payload ID: 2742
  Gene Symbol: CEP70
  Gene Name: centrosomal protein 70kDa
  ENSP ID: ENSP00000418131
MTEEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNV

SEQ ID NO: 14170 - protein, 71 aa, Homo sapiens
  Payload ID: 2742
  Gene Symbol: CEP70
  Gene Name: centrosomal protein 70kDa
  ENSP ID: ENSP00000418552
LCRLINEDVNEQVMQVLGPEDLQSIIYKLEEHEEFFPAFQAFTNDLLEILEWLFAFRRGDEAWYENKGMSQ

SEQ ID NO: 14171 - protein, 23 aa, Homo sapiens
  Payload ID: 2742
  Gene Symbol: CEP70
  Gene Name: centrosomal protein 70kDa
  ENSP ID: ENSP00000418878
MFPVAPKPQDSSQPSDRLMTEKQ

SEQ ID NO: 14172 - protein, 597 aa, Homo sapiens; identical to SEQ ID NO: 14165
  Payload ID: 2742
  Gene Symbol: CEP70
  Gene Name: centrosomal protein 70kDa
  Uniprot ID: Q8NHQ1
  ENSP ID: ENSP00000419231

SEQ ID NO: 14173 - protein, 212 aa, Homo sapiens
  Payload ID: 2742
  Gene Symbol: CEP70
  Gene Name: centrosomal protein 70kDa
  Uniprot ID: Q8NHQ1
  ENSP ID: ENSP00000419743
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQ

SEQ ID NO: 14174 - protein, 116 aa, Homo sapiens
  Payload ID: 2742
  Gene Symbol: CEP70
  Gene Name: centrosomal protein 70kDa
  ENSP ID: ENSP00000419817
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLE

SEQ ID NO: 14175 - protein, 579 aa, Homo sapiens
  Payload ID: 2742
  Gene Symbol: CEP70
  Gene Name: centrosomal protein 70kDa
  Uniprot ID: Q8NHQ1
  ENSP ID: ENSP00000419833
MTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 14176 - protein, 647 aa, Homo sapiens
  Payload ID: 2743
  Gene Symbol: CEP72
  Gene Name: centrosomal protein 72kDa
  Uniprot ID: Q9P209
  ENSP ID: ENSP00000264935
MARAGPRLVLSEEAVRAKSGLGPHRDLAELQSLSIPGTYQEKITHLGHSLMSLTGLKSLDLSRNSLVSLEGIQYLTALESLNLYYNCISSLAEVFRLHALTELVDVDFRLNPVVKVEPDYRLFVVHLLPKLQQLDDRPVRASERKASRLHFASEDSLDSKESVPASLKEGRPHHPRAKCTEALAKQSLVMDADDEAVLNLIAECEWDLGRPPGSTSFSQKGREADSRGSQESRHLLSPQLVQYQCGDSGKQGRETRRSSCRGCCLEKMPWSQLCGELPPLYGAEPEASRAPRPHTYFTPHPDSMDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQAALLETLLDLVDRSWGGCRSLHSNEAFLAQARHILSSVEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCGEIVELKQHLEHYDKIQELTQMLQESHSSLVSTNEHLLQELSQVRAQHRAEVEQMHWSYQELKKTMALFPHSSASHGGCQAC

SEQ ID NO: 14177 - protein, 170 aa, Homo sapiens
  Payload ID: 2743
  Gene Symbol: CEP72
  Gene Name: centrosomal protein 72kDa
  ENSP ID: ENSP00000486426
MARAGPRLVLSEEAVRAKSGLGPHRDLAELQSLSIPGTYQEKITHLGHSLMSLTGLKSLDLSRNSLVSLEGIQYLTALESLNLYYNCISSLAEVFRLHALTELVDVDFRLNPVVKVEPDYRLFVVHLLPKLQQLDDRPVRASERKASRLHFASEDSLDSKESVPASLKEG

SEQ ID NO: 14178 - protein, 659 aa, Homo sapiens
  Payload ID: 2744
  Gene Symbol: CEP76
  Gene Name: centrosomal protein 76kDa
  Uniprot ID: Q8TAP6
  ENSP ID: ENSP00000262127
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 14179 - protein, 584 aa, Homo sapiens
  Payload ID: 2744
  Gene Symbol: CEP76
  Gene Name: centrosomal protein 76kDa
  Uniprot ID: Q8TAP6
  ENSP ID: ENSP00000403074
MSLPPEKASELKQLIHQQLSKMDVHGRIREILAETIREELAPDQQHLSTEDLIKALRRRGIIDDVMKELNFVTDSVEQELPSSPKQPICFDRQSTLKKSDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 14180 - protein, 74 aa, Homo sapiens
  Payload ID: 2744
  Gene Symbol: CEP76
  Gene Name: centrosomal protein 76kDa
  ENSP ID: ENSP00000464760
MSLPPEKASELKQLIHQQLSKMDVHGRIREILAETIREELAPDQQHLSTEDLIKALRRRGIIDDVMKELNFVTC

SEQ ID NO: 14181 - protein, 178 aa, Homo sapiens
  Payload ID: 2744
  Gene Symbol: CEP76
  Gene Name: centrosomal protein 76kDa
  ENSP ID: ENSP00000464911
NIKLEMYPPLNQTLSQEVVNTQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLG

SEQ ID NO: 14182 - protein, 74 aa, Homo sapiens; identical to SEQ ID NO: 14180
  Payload ID: 2744
  Gene Symbol: CEP76
  Gene Name: centrosomal protein 76kDa
  ENSP ID: ENSP00000466689

SEQ ID NO: 14183 - protein, 112 aa, Homo sapiens
  Payload ID: 2744
  Gene Symbol: CEP76
  Gene Name: centrosomal protein 76kDa
  ENSP ID: ENSP00000466833
MSLPPEKASELKQLIHQQLSKMDVHGRIREILAETIREELAPDQQHLSTEDLIKALRRRGIIDDVMKELNFVTDSVEQELPSSPKQPICFDRQSTLKKSFGWKSFLGTSART

SEQ ID NO: 14184 - protein, 191 aa, Homo sapiens
  Payload ID: 2744
  Gene Symbol: CEP76
  Gene Name: centrosomal protein 76kDa
  ENSP ID: ENSP00000467224
EPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQVCKLY

SEQ ID NO: 14185 - protein, 101 aa, Homo sapiens
  Payload ID: 2744
  Gene Symbol: CEP76
  Gene Name: centrosomal protein 76kDa
  ENSP ID: ENSP00000467361
  MOD_RES (1)..(1): Any amino acid
XWRSVLGSENGVTSLTVELMGTESKVSVGILNIKLEMYPPLNQTLSQEVVNTQLALERQKTAEKERLFLVYAKQWWREYLQIRPSHNSRLVKIFAQVCKLY

SEQ ID NO: 14186 - protein, 705 aa, Homo sapiens
  Payload ID: 2745
  Gene Symbol: CEP78
  Gene Name: centrosomal protein 78kDa
  ENSP ID: ENSP00000277082
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 14187 - protein, 722 aa, Homo sapiens
  Payload ID: 2745
  Gene Symbol: CEP78
  Gene Name: centrosomal protein 78kDa
  Uniprot ID: Q5JTW2
  ENSP ID: ENSP00000365782
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIVGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQVSICMQSAYNEGTLMKFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 14188 - protein, 705 aa, Homo sapiens
  Payload ID: 2745
  Gene Symbol: CEP78
  Gene Name: centrosomal protein 78kDa
  Uniprot ID: Q5JTW2
  ENSP ID: ENSP00000365783
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQVSICMQSAYNEGTLMKFQKITGDARIPLPLDSFPVPVSTPEGLGTSSNNLGVPATEQRQESFEGFIARMCSPSPDATSGTGSQRKEEELSRNSRSSSEKKTKTESH

SEQ ID NO: 14189 - protein, 706 aa, Homo sapiens
  Payload ID: 2745
  Gene Symbol: CEP78
  Gene Name: centrosomal protein 78kDa
  Uniprot ID: Q5JTW2
  ENSP ID: ENSP00000399286
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIVGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 14190 - protein, 689 aa, Homo sapiens
  Payload ID: 2745
  Gene Symbol: CEP78
  Gene Name: centrosomal protein 78kDa
  Uniprot ID: Q5JTW2
  ENSP ID: ENSP00000411284
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTESH

SEQ ID NO: 14191 - protein, 701 aa, Homo sapiens
  Payload ID: 2746
  Gene Symbol: CEP83
  Gene Name: centrosomal protein 83kDa
  ENSP ID: ENSP00000344655
MVVSTFTDMDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 14192 - protein, 472 aa, Homo sapiens [sequence omitted]

SEQ ID NO: 14193 - protein, 701 aa, Homo sapiens; identical to SEQ ID NO: 14191
  Payload ID: 2746
  Gene Symbol: CEP83
  Gene Name: centrosomal protein 83kDa
  ENSP ID: ENSP00000380911

SEQ ID NO: 14194 - protein, 165 aa, Homo sapiens
  Payload ID: 2746
  Gene Symbol: CEP83
  Gene Name: centrosomal protein 83kDa
  ENSP ID: ENSP00000447094
EEKHKLHERITDREEKYNQAKEKLQRAAIAQKKRKSLHENKLKRLQEKVEVLEAKKEELETENQVLNRQNVPFEDYTRLQKRLKDIQRRHNEFRSLILVPNMPPTASINPVSFQSSAMVPSMELPFPPHMQEEQHQRELSLLRKRLEELETTQRKQLEELGSSGE

SEQ ID NO: 14195 - protein, 2 aa, Homo sapiens
  Payload ID: 2746
  Gene Symbol: CEP83
  Gene Name: centrosomal protein 83kDa
  ENSP ID: ENSP00000447449
MV

SEQ ID NO: 14196 - protein, 568 aa, Homo sapiens
  Payload ID: 2746
  Gene Symbol: CEP83
  Gene Name: centrosomal protein 83kDa
  Uniprot ID: Q9Y592
  ENSP ID: ENSP00000447783
MLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQKKLEQDLELGCPSVTDTYRESVFPPPPLKRDLLK

SEQ ID NO: 14197 - protein, 352 aa, Homo sapiens
  Payload ID: 2746
  Gene Symbol: CEP83
  Gene Name: centrosomal protein 83kDa
  ENSP ID: ENSP00000448913
MVVSTFTDMDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGNM

SEQ ID NO: 14198 - protein, 762 aa, Homo sapiens
  Payload ID: 2747
  Gene Symbol: CEP85
  Gene Name: centrosomal protein 85kDa
  Uniprot ID: Q6P2H3
  ENSP ID: ENSP00000252992
MAMQEKYPTEGISHVTSPSSDVIQKGSSLGTEWQTPVISEPFRSRFSRCSSVADSGDTAIGTSCSDIAEDFCSSSGSPPFQPIKSHVTIPTAHVMPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSAQHPETQLDLQKPDVIKRKLEEVQQLRRDIEDLRTTMSDRYAQDMGENCVTQ

SEQ ID NO: 14199 - protein, 435 aa, Homo sapiens
  Payload ID: 2747
  Gene Symbol: CEP85
  Gene Name: centrosomal protein 85kDa
  ENSP ID: ENSP00000391790
  MOD_RES (1)..(1): Any amino acid
XSILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSQHPETQLDLQKPDVIKRKLEEVQQLRRDIEDLRTTMSDRYAQDMGENCVTQ

SEQ ID NO: 14200 - protein, 711 aa, Homo sapiens
  Payload ID: 2747
  Gene Symbol: CEP85
  Gene Name: centrosomal protein 85kDa
  Uniprot ID: Q6P2H3
  ENSP ID: ENSP00000417002
MAMQEKYPTEGISHVTSPNFCSSSGSPPFQPIKSHVTIPTAHVMPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSAQHPETQLDLQKPDVIKRKLEEVQQLRRDIEDLRTTMSDRYAQDMGENCVTQ

SEQ ID NO: 14201 - protein, 761 aa, Homo sapiens
  Payload ID: 2747
  Gene Symbol: CEP85
  Gene Name: centrosomal protein 85kDa
  Uniprot ID: Q6P2H3
  ENSP ID: ENSP00000432354
MAMQEKYPTEGISHVTSPSSDVIQKGSSLGTEWQTPVISEPFRSRFSRCSSVADSGDTAIGTSCSDIAEDFCSSSGSPPFQPIKSHVTIPTAHVMPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSQHPETQLDLQKPDVIKRKLEEVQQLRRDIEDLRTTMSDRYAQDMGENCVTQ

SEQ ID NO: 14202 - protein, 394 aa, Homo sapiens
  Payload ID: 2748
  Gene Symbol: CEP85L
  Gene Name: centrosomal protein 85kDa-like
  Uniprot ID: Q5SZL2
  ENSP ID: ENSP00000353434
MPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 14203 - protein, 808 aa, Homo sapiens
  Payload ID: 2748
  Gene Symbol: CEP85L
  Gene Name: centrosomal protein 85kDa-like
  Uniprot ID: Q5SZL2
  ENSP ID: ENSP00000357474
MIWRNNWKSTTGRLNVKLQSDKLQHGCGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEPDQSRQQTVLSKRPLFDLTVIDQLFKEMSCCLFDLKALCSILNQRAQGKEPNLSLLLGIRSMNCSAEETENDHSTETLTKKLSDVCQLRRDIDELRTTISDRYAQDMGDNCITQ

SEQ ID NO: 14204 - protein, 805 aa, Homo sapiens
  Payload ID: 2748
  Gene Symbol: CEP85L
  Gene Name: centrosomal protein 85kDa-like
  Uniprot ID: Q5SZL2
  ENSP ID: ENSP00000357477
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEPDQSRQQTVLSKRPLFDLTVIDQLFKEMSCCLFDLKALCSILNQRAQGKEPNLSLLLGIRSMNCSAEETENDHSTETLTKKLSDVCQLRRDIDELRTTISDRYAQDMGDNCITQ

SEQ ID NO: 14205 - protein, 499 aa, Homo sapiens
  Payload ID: 2748
  Gene Symbol: CEP85L
  Gene Name: centrosomal protein 85kDa-like
  Uniprot ID: Q5SZL2
  ENSP ID: ENSP00000376288
MIWRNNWKSTTGRLNVKLQSDKLQHGCGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 14206 - protein, 576 aa, Homo sapiens
  Payload ID: 2748
  Gene Symbol: CEP85L
  Gene Name: centrosomal protein 85kDa-like
  ENSP ID: ENSP00000392131
MIWRNNWKSTTGRLNVKLQSDKLQHGCGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKE

SEQ ID NO: 14207 - protein, 496 aa, Homo sapiens
  Payload ID: 2748
  Gene Symbol: CEP85L
  Gene Name: centrosomal protein 85kDa-like
  Uniprot ID: Q5SZL2
  ENSP ID: ENSP00000393317
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 14208 - protein, 783 aa, Homo sapiens
  Payload ID: 2749
  Gene Symbol: CEP89
  Gene Name: centrosomal protein 89kDa
  Uniprot ID: Q96ST8
  ENSP ID: ENSP00000306105
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKEEMRMFRMRVQEVVKENEELHQELNKSSAVTSEEWRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQLQKEEEKERAEMEELMEKLTVLQAQKKSLLLEKNSLTEQNKALEAELERAQKINRKSQKKIEVLKKQVEKAMGNEMSAHQYLANLVGLAENITQERDSLMCLAKCLESEKDGVLNKVIKSNIRLGKLEEKVKGYKKQAALKLGDISHRLLEQQEDFAGKTAQYRQEMRHLHQVLKDKQEVLDQALQQNREMEGELEVIWESTFRENRRIRELLQDTLTRTGVQDNPRALVAPSLNGVSQADLLDGCDVCSYDLKSHAPTC

SEQ ID NO: 14209 - protein, 428 aa, Homo sapiens
  Payload ID: 2749
  Gene Symbol: CEP89
  Gene Name: centrosomal protein 89kDa
  ENSP ID: ENSP00000465141
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKASASDSSKTGFRGKQVVAGAVGDSAKESQGQPPGAPPRSF

SEQ ID NO: 14210 - protein, 356 aa, Homo sapiens
  Payload ID: 2749
  Gene Symbol: CEP89
  Gene Name: centrosomal protein 89kDa
  ENSP ID: ENSP00000466442
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEEVTFPIVKISFSDF

SEQ ID NO: 14211 - protein, 173 aa, Homo sapiens
  Payload ID: 2749
  Gene Symbol: CEP89
  Gene Name: centrosomal protein 89kDa
  ENSP ID: ENSP00000467544
EQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPGPTLLQDLWGVAFLVGNVCGASVPLPEFLSCVQEE

SEQ ID NO: 14212 - protein, 217 aa, Homo sapiens
  Payload ID: 2749
  Gene Symbol: CEP89
  Gene Name: centrosomal protein 89kDa
  ENSP ID: ENSP00000467839
  MOD_RES (1)..(1): Any amino acid
XAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPGICLLNYIMIEKLVLENIQINFI

SEQ ID NO: 14213 - protein, 80 aa, Homo sapiens
  Payload ID: 2749
  Gene Symbol: CEP89
  Gene Name: centrosomal protein 89kDa
  ENSP ID: ENSP00000481256
MLLGFRRGRRSHFKQGLALSPRLECSGAIIAHCILELLGSSDLPTPASRGAETTGARHYSRLIVQYFCGNRDLAMFLWWS

SEQ ID NO: 14214 - protein, 821 aa, Homo sapiens
  Payload ID: 2750
  Gene Symbol: CEP95
  Gene Name: centrosomal protein 95kDa
  Uniprot ID: Q96GE4
  ENSP ID: ENSP00000450461
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 14215 - protein, 756 aa, Homo sapiens
  Payload ID: 2750
  Gene Symbol: CEP95
  Gene Name: centrosomal protein 95kDa
  ENSP ID: ENSP00000450906
MAGSDAEWVTIANNLLFKCHIHLRIHELQDCDANVFIALYQSILGEKVPDLIVIPRSQEDDAHNVQAVIDSLALDYLQVSLSHITALYSVSRRKYSERRMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETVGKNIQRRSFVKELQNVVSPGRFTLEKPQRRVRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 14216 - protein, 99 aa, Homo sapiens
  Payload ID: 2750
  Gene Symbol: CEP95
  Gene Name: centrosomal protein 95kDa
  ENSP ID: ENSP00000452317
MAGSDAEWVTIANNLLFKCHIHLRIHELQDCDANVFIALYQSILGEKVPDLIVIPRSQEDDAHNVQAVIDSLALDYLQVSLSHITALYSVSRRKYSERR

SEQ ID NO: 14217 - protein, 135 aa, Homo sapiens
  Payload ID: 2750
  Gene Symbol: CEP95
  Gene Name: centrosomal protein 95kDa
  ENSP ID: ENSP00000461924
  MOD_RES (1)..(1): Any amino acid
XKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQEKIYRGEAVRKGTPECSQPWKIYSR

SEQ ID NO: 14218 - protein, 156 aa, Homo sapiens
  Payload ID: 2750
  Gene Symbol: CEP95
  Gene Name: centrosomal protein 95kDa
  ENSP ID: ENSP00000462189
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSKFKNGNLVWFTFYDVSLLPFIFLCIFLHRKQIH

SEQ ID NO: 14219 - protein, 102 aa, Homo sapiens
  Payload ID: 2750
  Gene Symbol: CEP95
  Gene Name: centrosomal protein 95kDa
  ENSP ID: ENSP00000462307
IFKKLFEEGLNIQKQRLRDLRNYAKEKRDEQRRRHQDELDSMENYYKDQFSLLAEAISQEHQELKAREKSQAQVLPTEQSPRPEKTGTFPALRGDRKLSSAT

SEQ ID NO: 14220 - protein, 74 aa, Homo sapiens
  Payload ID: 2750
  Gene Symbol: CEP95
  Gene Name: centrosomal protein 95kDa
  ENSP ID: ENSP00000462639
  MOD_RES (1)..(1): Any amino acid
XCSLSSEMLGPSWDGDEAESTGEIIRLGDTAHTFSLRSNGLALSPRVECGGAISAHCNLCLSLSSGWDYKCSMS

SEQ ID NO: 14221 - protein, 157 aa, Homo sapiens
  Payload ID: 2750
  Gene Symbol: CEP95
  Gene Name: centrosomal protein 95kDa
  ENSP ID: ENSP00000462779
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSAPCLLRCWAPLGMEMKQNPLVKSLDLETQHTPFL

SEQ ID NO: 14222 - protein, 71 aa, Homo sapiens
  Payload ID: 2750
  Gene Symbol: CEP95
  Gene Name: centrosomal protein 95kDa
  ENSP ID: ENSP00000463535
  MOD_RES (1)..(1): Any amino acid
XLDYLQVSLSHITGENIVKGDKESIKNLLEIFDGLLEYLTERISETSHEKSLIYTYLAIFPRADQVLQNAS

SEQ ID NO: 14223 - protein, 56 aa, Homo sapiens
  Payload ID: 2750
  Gene Symbol: CEP95
  Gene Name: centrosomal protein 95kDa
  ENSP ID: ENSP00000467102
MLGPSWDGDEAESTGEIIRLGDTAHTFSLRSNGAQCPNEMLSKKALASPSSKSHED

SEQ ID NO: 14224 - protein, 865 aa, Homo sapiens
  Payload ID: 2751
  Gene Symbol: CEP97
  Gene Name: centrosomal protein 97kDa
  Uniprot ID: Q8IW35
  ENSP ID: ENSP00000342510
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESEPVIQVNSWVGINSNDDQLFAVKNNFPASVHTTRYSRNDLHLEDIQTDEDKLNCSLLSSESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 14225 - protein, 806 aa, Homo sapiens
  Payload ID: 2751
  Gene Symbol: CEP97
  Gene Name: centrosomal protein 97kDa
  ENSP ID: ENSP00000418185
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 14226 - protein, 175 aa, Homo sapiens
  Payload ID: 2751
  Gene Symbol: CEP97
  Gene Name: centrosomal protein 97kDa
  ENSP ID: ENSP00000418547
IGCVEGLKELVHLEWLNLAGNNLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRGS

SEQ ID NO: 14227 - protein, 128 aa, Homo sapiens
  Payload ID: 2751
  Gene Symbol: CEP97
  Gene Name: centrosomal protein 97kDa
  ENSP ID: ENSP00000419009
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKCDAFLVIGHGTDQ

SEQ ID NO: 14228 - protein, 1221 aa, Homo sapiens
  Payload ID: 2752
  Gene Symbol: CSPP1
  Gene Name: centrosome and spindle pole associated protein 1
  Uniprot ID: Q1MSJ5
  ENSP ID: ENSP00000262210
MLFPLQVAAVTSSVRDDPLEHCVSPRTRARSPEICKMADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQERLKLERNKEYNQFLRGKEESSEKFRQVEKSTEPKSQRNKKPIGQVKPDLTSQIQTSCENSEGPRKDVLTPSEAYEELLNQRRLEEDRYRQLDDEIELRNRRIIKKANEEVGISNLKHQRFASKAGIPDRRFHRFNEDRVFDRRYHRPDQDPEVSEEMDERFRYESDFDRRLSRVYTNDRMHRNKRGNMPPMEHDGDVIEQSNIRISSAENKSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLITDLNRMHRQNIDAYHNPDARTYEDKRAVVSLDPNLATSNAENLEDAANKSSGHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 14229 - protein, 404 aa, Homo sapiens
  Payload ID: 2752
  Gene Symbol: CSPP1
  Gene Name: centrosome and spindle pole associated protein 1
  ENSP ID: ENSP00000428694
MADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQGITQGKRKKNFLSTSETDPSTLGVSLPIGERLSAKERLKLERNKEYNQFLRGKEESSEKFRQVEKSTEPKSQRNKKPIGQVKPDLTSQIQTSCENSEGPRKDVLTPSEAYEELLNQRRLEEDRYRQLDDEIELRNRRIIKKANEEVGISNLKHQRFASKAGIPDRRFHRFNEDRVFDRRYHRPDQDPEVSEEMDERFRYESDFDRRLSRVYTNDRMHRNKRGNMPPMEHDGDVIEQSNIRISSAENKSAPDNETSKSANQDTCSPFAGMLFGGEDRELIQRRKEKYRLELLEQMAEQQRNKRR

SEQ ID NO: 14230 - protein, 66 aa, Homo sapiens
  Payload ID: 2752
  Gene Symbol: CSPP1
  Gene Name: centrosome and spindle pole associated protein 1
  ENSP ID: ENSP00000428793
MADNLDEFIEEQKARLAEDKAELESDPPYMEMKNLALLARQDCNGVISARHNLRLPGSSDSSASAS

SEQ ID NO: 14231 - protein, 154 aa, Homo sapiens
  Payload ID: 2752
  Gene Symbol: CSPP1
  Gene Name: centrosome and spindle pole associated protein 1
  ENSP ID: ENSP00000429546
MADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQKNFLSTSETDPSTLGVSLPIGERLSAKERLKLERNKEYNQFLRGKEESSEKFR

SEQ ID NO: 14232 - protein, 876 aa, Homo sapiens
  Payload ID: 2752
  Gene Symbol: CSPP1
  Gene Name: centrosome and spindle pole associated protein 1
  Uniprot ID: Q1MSJ5
  ENSP ID: ENSP00000430092
MDERFRYESDFDRRLSRVYTNDRMHRNKRGNMPPMEHDGDVIEQSNIRISSAENKSAPDNETSKSANQDTCSPFAGMLFGGEDRELIQRRKEKYRLELLEQMAEQQRNKRREKDLELRVAASGAQDPEKSPDRLKQFSVAPRHFEEMIPPERPRIAFQTPLPPLSAPSVPPIPSVHPVPSQNEDLRSGLSSALGEMVSPRIAPLPPPPLLPPLATNYRTPYDDAYYFYGSRNTFDPSLAYYGSGMMGVQPAAYVSAPVTHQLAQPVVNTVGQNELKITSDQVINSGLIFEDKPKPSKQSLQSYQEALQQQIREREERRKKEREEKEEYEAKLEAEMRTYNPWGKGGGGAPLRDAKGNLISHMQTQSSPFARGNVFGEPPTELQIKQQELYKNFLRFQIEEKKQREEAERERLRIAEEKEERRLAEQRARIQQEYEEEQEKKREKEEEQRLKNEEHIRLAEERQKEAERKKKEEEEKYNLQLQHYCERDNLIGEETKHMRQPSPIVPALQNKIASKLQRPPSVDSIIRSFIHESSMSRAQSPPVPARKNQLRAEEEKKNVIMELSEMRKQLRSEERRLQERLLHMDSDDEIPIRKKERNPMDIFDMARHRLQAPVRRQSPKGLDAATFQNVHDFNELKDRDSETRVDLKFMYLDPPRDHHTLEIQQQALLREQQKRLNRIKMQEGAKVDLDAIPSAKVREQRMPRDDTSDFLKNSLLESDSAFIGAYGETYPAIEDDVLPPPSQLPSARERRRNKWKGLDIDSSRPNVAPDGLSLKSISSVNVDELRVRNEERMRRLNEFHNKPINTDDESSLVDPDDIMKHIGDDGSNSVATEPWLRPGTSETLKRFMAEQLNQEQQQIPGKPGTFTWQGLSTAHG

SEQ ID NO: 14233 - protein, 621 aa, Homo sapiens
  Payload ID: 2753
  Gene Symbol: CEP295NL
  Gene Name: CEP295 N-terminal like
  Uniprot ID: Q96MC4
  ENSP ID: ENSP00000312767
MCSGWSSSVIWRHTQFAVERCGFCGSSGPGAPLEPSTLGSKHLPWEAVSAGFADRNRNMDGAMWLSLCPDNEDLLWRKKHKLLQARGKGDLALQRRADAKLWKNYQLQRLAEELRRGYQEAQHLHVGGLDRLQSARLLGWGGGRARENEPDSQGPIQRRSARPPRAKEKHRAALSEERSCREELGQQHPRHSRPRKTAASPEKPQTTKATGRMNSHLAPPEKRKGRPEPSTKSGGGRCAIHPRRSKGADLERSNPLVAAVGEIGLVEEKEKGTARAGRRQLGKGAVCFVPALTSRSQGQSLEGKLRDLGQLWPADSSCRREAVSPASQCTLREKNKWQKELELAFEELFNINRKLKKHLCLYLALKPRMDQRPGEGHAFSEMQECGAGTPRGKKMADPEMLPAGEPRSPAEEEAQQAASKTDLKTFMGKAQNQKYQGTVKPTFRNGSQTLSPEAGIFINKEDSLLYSTESGQETPKLGTLAEGSLQLHLQDQADRVGSTASRQRQKAEMEQRRQKQLESLEQMEHPDMSLEIHYKAELEKERREQRRARLAHLKSSSTRAQERERGSELSTTSPSGTSLADDDRHSQMIRDQQQQILQQNRLHKQFLEEARKCLREFQNIC

SEQ ID NO: 14234 - protein, 32 aa, Homo sapiens
  Payload ID: 2753
  Gene Symbol: CEP295NL
  Gene Name: CEP295 N-terminal like
  ENSP ID: ENSP00000465968
MFKGPEKDIEFIYTAPSSAVCGVSLDVGGKKE

SEQ ID NO: 14235 - protein, 621 aa, Homo sapiens; identical to SEQ ID NO: 14233
  Payload ID: 2753
  Gene Symbol: CEP295NL
  Gene Name: CEP295 N-terminal like
  Uniprot ID: Q96MC4
  ENSP ID: ENSP00000483863

SEQ ID NO: 14236 - protein, 537 aa, Homo sapiens
  Payload ID: 2754
  Gene Symbol: CERK
  Gene Name: ceramide kinase
  Uniprot ID: Q8TCT0
  ENSP ID: ENSP00000216264
MGATGAAEPLQSVLWVKQQRCAVSLEPARALLRWWRSPGPGAGAPGADACSVPVSEIIAVEETDVHGKHQGSGKWQKMEKPYAFTVHCVKRARRHRWKWAQVTFWCPEEQLCHLWLQTLREMLEKLTSRPKHLLVFINPFGGKGQGKRIYERKVAPLFTLASITTDIIVTEHANQAKETLYEINIDKYDGIVCVGGDGMFSEVLHGLIGRTQRSAGVDQNHPRAVLVPSSLRIGIIPAGSTDCVCYSTVGTSDAETSALHIVVGDSLAMDVSSVHHNSTLLRYSVSLLGYGFYGDIIKDSEKKRWLGLARYDFSGLKTFLSHHCYEGTVSFLPAQHTVGSPRDRKPCRAGCFVCRQSKQQLEEEQKKALYGLEAAEDVEEWQVVCGKFLAINATNMSCACRRSPRGLSPAAHLGDGSSDLILIRKCSRFNFLRFLIRHTNQQDQFDFTFVEVYRVKKFQFTSKHMEDEDSDLKEGGKKRFGHICSSHPSCCCTVSNSSWNCDGEVLHSPAIEVRVHCQLVRLFARGIEENPKPDSHS

SEQ ID NO: 14237 - protein, 185 aa, Homo sapiens
  Payload ID: 2754
  Gene Symbol: CERK
  Gene Name: ceramide kinase
  ENSP ID: ENSP00000400859
MGATGAAEPLQSVLWVKQQRCAVSLEPARALLRWWRSPGPGAGAPGADACSVPVSEIIAVEETDVHGKHQGSGKWQKMEKPYAFTVHCVKRARRHRWKWAQVTFWCPEEQLCHLWLQTLREMLEKLTSRPKHLLVFINPFGGKGQGKRIYERKVAPLFTLASITTDIIASSVSAEMVCSARCCTV

SEQ ID NO: 14238 - protein, 558 aa, Homo sapiens
  Payload ID: 2755
  Gene Symbol: CERKL
  Gene Name: ceramide kinase-like
  Uniprot ID: Q49MI3
  ENSP ID: ENSP00000341159
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGGHRKPLFAIHWSVQRLFTGMQTLEPSVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 14239 - protein, 217 aa, Homo sapiens
  Payload ID: 2755
  Gene Symbol: CERKL
  Gene Name: ceramide kinase-like
  Uniprot ID: Q49MI3
  ENSP ID: ENSP00000364106
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTMLSVLVEMDLLAK

SEQ ID NO: 14240 - protein, 419 aa, Homo sapiens
  Payload ID: 2755
  Gene Symbol: CERKL
  Gene Name: ceramide kinase-like
  Uniprot ID: Q49MI3
  ENSP ID: ENSP00000364108
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 14241 - protein, 463 aa, Homo sapiens
  Payload ID: 2755
  Gene Symbol: CERKL
  Gene Name: ceramide kinase-like
  Uniprot ID: Q49MI3
  ENSP ID: ENSP00000364109
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTRSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 14242 - protein, 532 aa, Homo sapiens
  Payload ID: 2755
  Gene Symbol: CERKL
  Gene Name: ceramide kinase-like
  Uniprot ID: Q49MI3
  ENSP ID: ENSP00000386725
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 14243 - protein, 514 aa, Homo sapiens
  Payload ID: 2755
  Gene Symbol: CERKL
  Gene Name: ceramide kinase-like
  Uniprot ID: Q49MI3
  ENSP ID: ENSP00000387080
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAVMEYEGHALSLLKECELQGFDGGHRKPLFAIHWSVQRLFTGMQTLEPSVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 14244 - protein, 173 aa, Homo sapiens
  Payload ID: 2755
  Gene Symbol: CERKL
  Gene Name: ceramide kinase-like
  Uniprot ID: Q49MI3
  ENSP ID: ENSP00000409198
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAVLSVLVEMDLLAK

SEQ ID NO: 14245 - protein, 173 aa, Homo sapiens; identical to SEQ ID NO: 14244
  Payload ID: 2755
  Gene Symbol: CERKL
  Gene Name: ceramide kinase-like
  Uniprot ID: Q49MI3
  ENSP ID: ENSP00000411466

SEQ ID NO: 14246 - protein, 337 aa, Homo sapiens
  Payload ID: 2756
  Gene Symbol: CERS1
  Gene Name: ceramide synthase 1
  Uniprot ID: P27544
  ENSP ID: ENSP00000389044
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 14247 - protein, 239 aa, Homo sapiens
  Payload ID: 2756
  Gene Symbol: CERS1
  Gene Name: ceramide synthase 1
  ENSP ID: ENSP00000437648
MPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 14248 - protein, 216 aa, Homo sapiens
  Payload ID: 2756
  Gene Symbol: CERS1
  Gene Name: ceramide synthase 1
  ENSP ID: ENSP00000471428
  MOD_RES (1)..(1): Any amino acid
XAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEEAVAQSSVTFFGTGGARCRHLTHPGL

SEQ ID NO: 14249 - protein, 350 aa, Homo sapiens
  Payload ID: 2756
  Gene Symbol: CERS1
  Gene Name: ceramide synthase 1
  Uniprot ID: P27544
  ENSP ID: ENSP00000485308
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRF

SEQ ID NO: 14250 - protein, 372 aa, Homo sapiens
  Payload ID: 2756
  Gene Symbol: CERS1
  Gene Name: ceramide synthase 1
  ENSP ID: ENSP00000485582
MPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 14251 - protein, 380 aa, Homo sapiens
  Payload ID: 2757
  Gene Symbol: CERS2
  Gene Name: ceramide synthase 2
  Uniprot ID: Q96G23
  ENSP ID: ENSP00000271688
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 14252 - protein, 249 aa, Homo sapiens
  Payload ID: 2757
  Gene Symbol: CERS2
  Gene Name: ceramide synthase 2
  ENSP ID: ENSP00000355020
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLEVR

SEQ ID NO: 14253 - protein, 304 aa, Homo sapiens
  Payload ID: 2757
  Gene Symbol: CERS2
  Gene Name: ceramide synthase 2
  ENSP ID: ENSP00000357945
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYF

SEQ ID NO: 14254 - protein, 380 aa, Homo sapiens; identical to SEQ ID NO: 14251
  Payload ID: 2757
  Gene Symbol: CERS2
  Gene Name: ceramide synthase 2
  Uniprot ID: Q96G23
  ENSP ID: ENSP00000357950

SEQ ID NO: 14255 - protein, 192 aa, Homo sapiens
  Payload ID: 2757
  Gene Symbol: CERS2
  Gene Name: ceramide synthase 2
  ENSP ID: ENSP00000393239
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWS

SEQ ID NO: 14256 - protein, 128 aa, Homo sapiens
  Payload ID: 2757
  Gene Symbol: CERS2
  Gene Name: ceramide synthase 2
  ENSP ID: ENSP00000394012
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPS

SEQ ID NO: 14257 - protein, 222 aa, Homo sapiens
  Payload ID: 2757
  Gene Symbol: CERS2
  Gene Name: ceramide synthase 2
  ENSP ID: ENSP00000452810
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISF

SEQ ID NO: 14258 - protein, 228 aa, Homo sapiens
  Payload ID: 2757
  Gene Symbol: CERS2
  Gene Name: ceramide synthase 2
  ENSP ID: ENSP00000453297
  MOD_RES (1)..(1): Any amino acid
XSLQKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 14259 - protein, 377 aa, Homo sapiens
  Payload ID: 2757
  Gene Symbol: CERS2
  Gene Name: ceramide synthase 2
  ENSP ID: ENSP00000454160
MLQTLYDYFWWERLWLPVNLTWADLEDRDGRVYAKASDLYITLPLALLFLIVRYFFELYVATPLAALLNIKEKTRLRAPPNATLEHFYLTSGKQPKQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKELGGVASPETSGQGSTIRKTQFLRKRQFKKGWEEGCPLKKTSSAFNGPTATE

SEQ ID NO: 14260 - protein, 383 aa, Homo sapiens
  Payload ID: 2758
  Gene Symbol: CERS3
  Gene Name: ceramide synthase 3
  Uniprot ID: Q8IU89
  ENSP ID: ENSP00000284382
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKDFLAHIIHHLAAISLMSFSWCANYIRSGTLVMIVHDVADIWLESAKMFSYAGWTQTCNTLFFIFSTIFFISRLIVFPFWILYCTLILPMYHLEPFFSYIFLNLQLMILQVLHLYWGYYILKMLNRCIFMKSIQDVRSDDEDYEEEEEEEEEEATKGKEMDCLKNGLRAERHLIPNGQHGH

SEQ ID NO: 14261 - protein, 383 aa, Homo sapiens; identical to SEQ ID NO: 14260
  Payload ID: 2758
  Gene Symbol: CERS3
  Gene Name: ceramide synthase 3
  Uniprot ID: Q8IU89
  ENSP ID: ENSP00000377672

SEQ ID NO: 14262 - protein, 383 aa, Homo sapiens; identical to SEQ ID NO: 14260
  Payload ID: 2758
  Gene Symbol: CERS3
  Gene Name: ceramide synthase 3
  Uniprot ID: Q8IU89
  ENSP ID: ENSP00000437640

SEQ ID NO: 14263 - protein, 15 aa, Homo sapiens
  Payload ID: 2758
  Gene Symbol: CERS3
  Gene Name: ceramide synthase 3
  ENSP ID: ENSP00000453598
MFWTFKEWFWLERFW

SEQ ID NO: 14264 - protein, 162 aa, Homo sapiens
  Payload ID: 2758
  Gene Symbol: CERS3
  Gene Name: ceramide synthase 3
  ENSP ID: ENSP00000453816
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDL

SEQ ID NO: 14265 - protein, 394 aa, Homo sapiens
  Payload ID: 2759
  Gene Symbol: CERS4
  Gene Name: ceramide synthase 4
  Uniprot ID: Q9HA82
  ENSP ID: ENSP00000251363
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 14266 - protein, 343 aa, Homo sapiens
  Payload ID: 2759
  Gene Symbol: CERS4
  Gene Name: ceramide synthase 4
  ENSP ID: ENSP00000452753
MRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 14267 - protein, 136 aa, Homo sapiens
  Payload ID: 2759
  Gene Symbol: CERS4
  Gene Name: ceramide synthase 4
  ENSP ID: ENSP00000452910
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEA

SEQ ID NO: 14268 - protein, 31 aa, Homo sapiens
  Payload ID: 2759
  Gene Symbol: CERS4
  Gene Name: ceramide synthase 4
  ENSP ID: ENSP00000452920
MLSSFNEWFWQDRFWLPPNVTWTELEDRDGR

SEQ ID NO: 14269 - protein, 113 aa, Homo sapiens
  Payload ID: 2759
  Gene Symbol: CERS4
  Gene Name: ceramide synthase 4
  ENSP ID: ENSP00000453388
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQ

SEQ ID NO: 14270 - protein, 394 aa, Homo sapiens; identical to SEQ ID NO: 14265
  Payload ID: 2759
  Gene Symbol: CERS4
  Gene Name: ceramide synthase 4
  Uniprot ID: Q9HA82
  ENSP ID: ENSP00000453509

SEQ ID NO: 14271 - protein, 92 aa, Homo sapiens
  Payload ID: 2759
  Gene Symbol: CERS4
  Gene Name: ceramide synthase 4
  ENSP ID: ENSP00000453796
MLSSFNEWFWQDRFWLPPNVTWTELEDRDGRVYPHPQDLLAALPLALVLLAMRLAFERFIGLPLSRWLGVRDQTRRQVKPNATLEKHFLTEG

SEQ ID NO: 14272 - protein, 306 aa, Homo sapiens
  Payload ID: 2759
  Gene Symbol: CERS4
  Gene Name: ceramide synthase 4
  ENSP ID: ENSP00000453815
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEMEKDIRSDVEESDSSEEAAAAQEPLQLKNGAAGGPRPAPTDGPRSRVAGRLTNRHTTAT

SEQ ID NO: 14273 - protein, 192 aa, Homo sapiens
  Payload ID: 2759
  Gene Symbol: CERS4
  Gene Name: ceramide synthase 4
  ENSP ID: ENSP00000454122
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLS

SEQ ID NO: 14274 - protein, 392 aa, Homo sapiens
  Payload ID: 2760
  Gene Symbol: CERS5
  Gene Name: ceramide synthase 5
  Uniprot ID: Q8N5B7
  ENSP ID: ENSP00000325485
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 14275 - protein, 195 aa, Homo sapiens
  Payload ID: 2760
  Gene Symbol: CERS5
  Gene Name: ceramide synthase 5
  ENSP ID: ENSP00000369536
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESIHLGSGTSDSAGITIHFSLFQVGFITIISWNWPSIGPLCFLSLQTLKERTS

SEQ ID NO: 14276 - protein, 334 aa, Homo sapiens
  Payload ID: 2760
  Gene Symbol: CERS5
  Gene Name: ceramide synthase 5
  Uniprot ID: Q8N5B7
  ENSP ID: ENSP00000389050
MMKPRPKRFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 14277 - protein, 179 aa, Homo sapiens
  Payload ID: 2760
  Gene Symbol: CERS5
  Gene Name: ceramide synthase 5
  ENSP ID: ENSP00000407896
MATAAQGPLSLLWGWLWSERFWLPENVSWADLEGPADGYGYPRGRHILSVFPLAAGIFFVRLLFERILIRKGWRACQSSWIGMSEKSNAGFAIGGIRTSPQRLLNSVKACGDSHFIYVYSAMELDFSGRHLGSGTSDSAGITIHFSLFQVGFITIISWNWPSIGPLCFLSLQTLKERTS

SEQ ID NO: 14278 - protein, 195 aa, Homo sapiens; identical to SEQ ID NO: 14275
  Payload ID: 2760
  Gene Symbol: CERS5
  Gene Name: ceramide synthase 5
  ENSP ID: ENSP00000442918

SEQ ID NO: 14279 - protein, 77 aa, Homo sapiens
  Payload ID: 2760
  Gene Symbol: CERS5
  Gene Name: ceramide synthase 5
  ENSP ID: ENSP00000446931
MATAAQGPLSLLWGWLWSERFWLPENVSWADLEGPADGYGYPRGRHILSVFPLAAGIFFVRLLFERVCFVAQTGVQW

SEQ ID NO: 14280 - protein, 66 aa, Homo sapiens
  Payload ID: 2760
  Gene Symbol: CERS5
  Gene Name: ceramide synthase 5
  ENSP ID: ENSP00000446937
MATAAQGPLSLLWGWLWSERFWLPENVSWADLEGPADGYGYPRGRHILSVFPLAAGIFFVRLLFER

SEQ ID NO: 14281 - protein, 136 aa, Homo sapiens
  Payload ID: 2760
  Gene Symbol: CERS5
  Gene Name: ceramide synthase 5
  ENSP ID: ENSP00000447029
  MOD_RES (1)..(1): Any amino acid
XLCIFCYGIRFLWSDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARI

SEQ ID NO: 14282 - protein, 111 aa, Homo sapiens
  Payload ID: 2760
  Gene Symbol: CERS5
  Gene Name: ceramide synthase 5
  ENSP ID: ENSP00000447266
  MOD_RES (1)..(1): Any amino acid
XLFVIFSAVFMVTRLGIYPFWILNTTLFESWEIIGPYASWWLLNGLLLTLQLLHVIWSYLIARIALKALIRGKVTCPGRIRPCTLHSFLTSFLFSMPGGSWTVSSLACIEG

SEQ ID NO: 14283 - protein, 73 aa, Homo sapiens
  Payload ID: 2760
  Gene Symbol: CERS5
  Gene Name: ceramide synthase 5
  ENSP ID: ENSP00000447410
MATAAQGPLSLLWGWLWSERFWLPENVSWADLEGPADGYGYPRGRHILSVFPLAAGIFFVRLLFERRDGVSLC

SEQ ID NO: 14284 - protein, 93 aa, Homo sapiens
  Payload ID: 2760
  Gene Symbol: CERS5
  Gene Name: ceramide synthase 5
  ENSP ID: ENSP00000448257
MATAAQGPLSLLWGWLWSERFWLPENVSWADLEGPADGYGYPRGRHILSVFPLAAGIFFVRLLFERWCFALVAQAGVQWCSHSSLQPLPPRFK

SEQ ID NO: 14285 - protein, 259 aa, Homo sapiens
  Payload ID: 2760
  Gene Symbol: CERS5
  Gene Name: ceramide synthase 5
  ENSP ID: ENSP00000448295
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQDFLIMFVHHLVTIGLISFSYINNMVRVGTLIMCLHDVSDFLLEAAKLANYAKYQRLCDTLFVIFSAVFMVTRLGIYPF

SEQ ID NO: 14286 - protein, 93 aa, Homo sapiens
  Payload ID: 2760
  Gene Symbol: CERS5
  Gene Name: ceramide synthase 5
  ENSP ID: ENSP00000448755
MATAAQGPLSLLWGWLWSERFWLPENVSWADLEGPADGYGYPRGRHILSVFPLAAGIFFVRLLFERLECSGAISLQPSTPWFKRFSCLSLPSS

SEQ ID NO: 14287 - protein, 351 aa, Homo sapiens
  Payload ID: 2760
  Gene Symbol: CERS5
  Gene Name: ceramide synthase 5
  ENSP ID: ENSP00000448794
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFCFSVLFYSTFANRTQEPYCPAFTLACADLLWTLIGPLLPQTVFLARSDPDSEYPAWLASQD

SEQ ID NO: 14288 - protein, 78 aa, Homo sapiens
  Payload ID: 2760
  Gene Symbol: CERS5
  Gene Name: ceramide synthase 5
  ENSP ID: ENSP00000449311
  MOD_RES (1)..(1): Any amino acid
XYINNMVRVGTLIMCLHDVSDFLLEAAKLANYAKYQRLCDTLFVIFSAVFMVTRLGIYPFWYRRMIAVMWRAAQRKKM

SEQ ID NO: 14289 - protein, 77 aa, Homo sapiens
  Payload ID: 2760
  Gene Symbol: CERS5
  Gene Name: ceramide synthase 5
  ENSP ID: ENSP00000450072
MATAAQGPLSLLWGWLWSERFWLPENVSWADLEGPADGYGYPRGRHILSVFPLAAGIFFVRLLFERVQAILLPQPPK

SEQ ID NO: 14290 - protein, 384 aa, Homo sapiens
  Payload ID: 2761
  Gene Symbol: CERS6
  Gene Name: ceramide synthase 6
  Uniprot ID: Q6ZMG9
  ENSP ID: ENSP00000306579
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 14291 - protein, 392 aa, Homo sapiens
  Payload ID: 2761
  Gene Symbol: CERS6
  Gene Name: ceramide synthase 6
  Uniprot ID: Q6ZMG9
  ENSP ID: ENSP00000376453
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKAGKWNPLHVSKDDRSDIESSSDEEDSEPPGKNPHTATTTNGTSGTNGYLLTGSCSMDD

SEQ ID NO: 14292 - protein, 214 aa, Homo sapiens
  Payload ID: 2762
  Gene Symbol: CPTP
  Gene Name: ceramide-1-phosphate transfer protein
  Uniprot ID: Q5TA50
  ENSP ID: ENSP00000343890
MDDSETGFNLKVVLVSFKQCLDEKEEVLLDPYIASWKGLVRFLNSLGTIFSFISKDVVSKLRIMERLRGGPQSEHYRSLQAMVAHELSNRLVDLERRSHHPESGCRTVLRLHRALHWLQLFLEGLRTSPEDARTSALCADSYNASLAAYHPWVVRRAVTVAFCTLPTREVFLEAMNVGPPEQAVQMLGEALPFIQRVYNVSQKLYAEHSLLDLP

SEQ ID NO: 14293 - protein, 117 aa, Homo sapiens
  Payload ID: 2762
  Gene Symbol: CPTP
  Gene Name: ceramide-1-phosphate transfer protein
  ENSP ID: ENSP00000462636
MDDSETGFNLKVVLVSFKQCLDEKEEVLLDPYIASWKGLVRFLNSLGTIFSFISKDVVSKLRIMERLRGGPQSEHYRSLQAMVAHELSNRLVDLERRSHHPESGCRTVLRLHRALHW

SEQ ID NO: 14294 - protein, 267 aa, Homo sapiens
  Payload ID: 2763
  Gene Symbol: CER1
  Gene Name: cerberus 1, DAN family BMP antagonist
  Uniprot ID: O95813
  ENSP ID: ENSP00000370297
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 14295 - protein, 262 aa, Homo sapiens
  Payload ID: 2764
  Gene Symbol: CDR1
  Gene Name: cerebellar degeneration-related protein 1, 34kDa
  Uniprot ID: P51861
  ENSP ID: ENSP00000359563
MAWLEDVDFLEDVPLLEDIPLLEDVPLLEDVPLLEDTSRLEDINLMEDMALLEDVDLLEDTDFLEDLDFSEAMDLREDKDFLEDMDSLEDMALLEDVDLLEDTDFLEDPDFLEAIDLREDKDFLEDMDSLEDLEAIGRCGFSGRHGFFGRRRFSGRPKLSGRLGLLGRRGFSGRLGGYWKTWIFWKTWIFWKTWIFRKTYIGWKTWIFSGRCGLTGRPGFGGRRRFFWKTLTDWKTWISFWKTLIDWKTWISFWKTLIDWKI

SEQ ID NO: 14296 - protein, 454 aa, Homo sapiens
  Payload ID: 2765
  Gene Symbol: CDR2
  Gene Name: cerebellar degeneration-related protein 2, 62kDa
  Uniprot ID: Q01850
  ENSP ID: ENSP00000268383
MLAENLVEEFEMKEDEPWYDHQDLQQDLQLAAELGKTLLDRNTELEDSVQQMYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 14297 - protein, 62 aa, Homo sapiens
  Payload ID: 2765
  Gene Symbol: CDR2
  Gene Name: cerebellar degeneration-related protein 2, 62kDa
  ENSP ID: ENSP00000454706
MNEQHAKVYEQLDVTARELEETNQKLVADSKASQQKILSLTETIECLQTNIDHLQSQVEELK

SEQ ID NO: 14298 - protein, 46 aa, Homo sapiens
  Payload ID: 2765
  Gene Symbol: CDR2
  Gene Name: cerebellar degeneration-related protein 2, 62kDa
  ENSP ID: ENSP00000455915
MLAENLVEEFEMKEDEPWYDHQDLQQVSDEASGTSTADERTTCKGL

SEQ ID NO: 14299 - protein, 116 aa, Homo sapiens
  Payload ID: 2765
  Gene Symbol: CDR2
  Gene Name: cerebellar degeneration-related protein 2, 62kDa
  ENSP ID: ENSP00000457289
MNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPD

SEQ ID NO: 14300 - protein, 234 aa, Homo sapiens
  Payload ID: 2765
  Gene Symbol: CDR2
  Gene Name: cerebellar degeneration-related protein 2, 62kDa
  ENSP ID: ENSP00000457432
MYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKE

SEQ ID NO: 14301 - protein, 80 aa, Homo sapiens
  Payload ID: 2765
  Gene Symbol: CDR2
  Gene Name: cerebellar degeneration-related protein 2, 62kDa
  ENSP ID: ENSP00000457596
  MOD_RES (1)..(1): Any amino acid
XARELEETNQKLVADSKASQQKILSLTETIECLQTNIDHLQSQVEELKSSGQGRRSPGKCDQEKPAPSFACLKELYDLRQ

SEQ ID NO: 14302 - protein, 465 aa, Homo sapiens
  Payload ID: 2766
  Gene Symbol: CDR2L
  Gene Name: cerebellar degeneration-related protein 2-like
  Uniprot ID: Q86X02
  ENSP ID: ENSP00000336587
MRRAAGMEDFSAEEEESWYDQQDLEQDLHLAAELGKTLLERNKELEGSLQQMYSTNEEQVQEIEYLTKQLDTLRHVNEQHAKVYEQLDLTARDLELTNHRLVLESKAAQQKIHGLTETIERLQAQVEELQAQVEQLRGLEQLRVLREKRERRRTIHTFPCLKELCTSPRCKDAFRLHSSSLELGPRPLEQENERLQTLVGALRSQVSQERQRKERAEREYTAVLQEYSELERQLCEMEACRLRVQELEAELLELQQMKQAKTYLLGPDDHLAEALLAPLTQAPEADDPQPGRGDDLGAQDGVSSPAASPGHVVRKSCSDTALNAIVAKDPASRHAGNLTLHANSVRKRGMSILREVDEQYHALLEKYEELLSKCRQHGAGVRHAGVQTSRPISRDSSWRDLRGGEEGQGEVKAGEKSLSQHVEAVDKRLEQSQPEYKALFKEIFSRIQKTKADINATKVKTHSSK

SEQ ID NO: 14303 - protein, 193 aa, Homo sapiens
  Payload ID: 2767
  Gene Symbol: CBLN1
  Gene Name: cerebellin 1 precursor
  Uniprot ID: P23435
  ENSP ID: ENSP00000219197
MLGVLELLLLGAAWLAGPARGQNETEPIVLEGKCLVVCDSNPTSDPTGTALGISVRSGSAKVAFSAIRSTNHEPSEMSNRTMIIYFDQVLVNIGNNFDSERSTFIAPRKGIYSFNFHVVKVYNRQTIQVSLMLNGWPVISAFAGDQDVTREAASNGVLIQMEKGDRAYLKLERGNLMGGWKYSTFSGFLVFPL

SEQ ID NO: 14304 - protein, 193 aa, Homo sapiens; identical to SEQ ID NO: 14303
  Payload ID: 2767
  Gene Symbol: CBLN1
  Gene Name: cerebellin 1 precursor
  Uniprot ID: P23435
  ENSP ID: ENSP00000444651

SEQ ID NO: 14305 - protein, 140 aa, Homo sapiens
  Payload ID: 2767
  Gene Symbol: CBLN1
  Gene Name: cerebellin 1 precursor
  ENSP ID: ENSP00000455718
MLGVLELLLLGAAWLAGPARGQNETEPIVLEGKCLVVCDSNPTSDPTGTALGISVRSGSAKVAFSAIRSTNHEPSEMSNRTMIIYFDQVSVPSSRGVQIGLVKEGWMEDRCPVLSKGSAEARGRQSGTDSCPLPFVPVSL

SEQ ID NO: 14306 - protein, 224 aa, Homo sapiens
  Payload ID: 2768
  Gene Symbol: CBLN2
  Gene Name: cerebellin 2 precursor
  Uniprot ID: Q8IUK8
  ENSP ID: ENSP00000269503
MQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 14307 - protein, 110 aa, Homo sapiens
  Payload ID: 2768
  Gene Symbol: CBLN2
  Gene Name: cerebellin 2 precursor
  ENSP ID: ENSP00000462632
MDWDKVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 14308 - protein, 224 aa, Homo sapiens; identical to SEQ ID NO: 14306
  Payload ID: 2768
  Gene Symbol: CBLN2
  Gene Name: cerebellin 2 precursor
  Uniprot ID: Q8IUK8
  ENSP ID: ENSP00000463771

SEQ ID NO: 14309 - protein, 108 aa, Homo sapiens
  Payload ID: 2768
  Gene Symbol: CBLN2
  Gene Name: cerebellin 2 precursor
  ENSP ID: ENSP00000464490
MFQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 14310 - protein, 205 aa, Homo sapiens
  Payload ID: 2769
  Gene Symbol: CBLN3
  Gene Name: cerebellin 3 precursor
  Uniprot ID: Q6UW01
  ENSP ID: ENSP00000267406
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 14311 - protein, 154 aa, Homo sapiens
  Payload ID: 2769
  Gene Symbol: CBLN3
  Gene Name: cerebellin 3 precursor
  ENSP ID: ENSP00000450935
MWGLSGQSFGRTLTPTLKMRSTWGCCSRTLFSASADTAKRSGDAGRAPQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 14312 - protein, 201 aa, Homo sapiens
  Payload ID: 2770
  Gene Symbol: CBLN4
  Gene Name: cerebellin 4 precursor
  Uniprot ID: Q9NTU7
  ENSP ID: ENSP00000064571
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 14313 - protein, 442 aa, Homo sapiens [sequence omitted]

SEQ ID NO: 14314 - protein, 228 aa, Homo sapiens
  Payload ID: 2771
  Gene Symbol: CRBN
  Gene Name: cereblon
  ENSP ID: ENSP00000392073
  MOD_RES (1)..(1): Any amino acid
XDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKVRN

SEQ ID NO: 14315 - protein, 394 aa, Homo sapiens
  Payload ID: 2771
  Gene Symbol: CRBN
  Gene Name: cereblon
  ENSP ID: ENSP00000411047
  MOD_RES (1)..(1): Any amino acid
XDQQDAAHNMGNHLPLLPAESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFRYAWTVAQCKICASHIGWKFTATKKDMSPQKFWGLTRSALLPTIPDTEDEISPDKVILCL

SEQ ID NO: 14316 - protein, 441 aa, Homo sapiens
  Payload ID: 2771
  Gene Symbol: CRBN
  Gene Name: cereblon
  Uniprot ID: Q96SW2
  ENSP ID: ENSP00000412499
MAGEGDQQDAAHNMGNHLPLLPESEEEDEMEVEDQDSKEAKKPNIINFDTSLPTSHTYLGADMEEFHGRTLHDDDSCQVIPVLPQVMMILIPGQTLPLQLFHPQEVSMVRNLIQKDRTFAVLAYSNVQEREAQFGTTAEIYAYREEQDFGIEIVKVKAIGRQRFKVLELRTQSDGIQQAKVQILPECVLPSTMSAVQLESLNKCQIFPSKPVSREDQCSYKWWQKYQKRKFHCANLTSWPRWLYSLYDAETLMDRIKKQLREWDENLKDDSLPSNPIDFSYRVAACLPIDDVLRIQLLKIGSAIQRLRCELDIMNKCTSLCCKQCQETEITTKNEIFSLSLCGPMAAYVNPHGYVHETLTVYKACNLNLIGRPSTEHSWFPGYAWTVAQCKICASHIGWKFTATKKDMSPQKFWGLTRSALLPTIPDTEDEISPDKVILCL

SEQ ID NO: 14317 - protein, 444 aa, Homo sapiens
  Payload ID: 2772
  Gene Symbol: CCM2
  Gene Name: cerebral cavernous malformation 2
  Uniprot ID: Q9BSQ5
  ENSP ID: ENSP00000258781
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 14318 - protein, 465 aa, Homo sapiens
  Payload ID: 2772
  Gene Symbol: CCM2
  Gene Name: cerebral cavernous malformation 2
  Uniprot ID: Q9BSQ5
  ENSP ID: ENSP00000370503
MHSSCRQRRNQNLSKEIPQTEFHTGYSMENEPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 14319 - protein, 438 aa, Homo sapiens
  Payload ID: 2772
  Gene Symbol: CCM2
  Gene Name: cerebral cavernous malformation 2
  ENSP ID: ENSP00000417180
MENEPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 14320 - protein, 271 aa, Homo sapiens
  Payload ID: 2772
  Gene Symbol: CCM2
  Gene Name: cerebral cavernous malformation 2
  ENSP ID: ENSP00000417251
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSAASLNLWMWVVHHPTARPSVRAS

SEQ ID NO: 14321 - protein, 135 aa, Homo sapiens
  Payload ID: 2772
  Gene Symbol: CCM2
  Gene Name: cerebral cavernous malformation 2
  ENSP ID: ENSP00000418763
  MOD_RES (1)..(1): Any amino acid
XGLSAGSLSESAVGPVEACCLVILAAESKVAAEELCCLLGQVFQVVYTESTIDFLDRAIFDGASTPTHHLSLHSASHVTSSTVTSSFDCQLPLHFRTLAITLSPPKFSRVISLFQDDSSTKVDIKETYEVEASTL

SEQ ID NO: 14322 - protein, 347 aa, Homo sapiens
  Payload ID: 2772
  Gene Symbol: CCM2
  Gene Name: cerebral cavernous malformation 2
  ENSP ID: ENSP00000419474
MENEPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 14323 - protein, 353 aa, Homo sapiens
  Payload ID: 2772
  Gene Symbol: CCM2
  Gene Name: cerebral cavernous malformation 2
  Uniprot ID: Q9BSQ5
  ENSP ID: ENSP00000438035
MEEEGKKGKKPGIVSPFKRVFLKGEKSRDKKAHEKVTERRPLHTVVLSLPERVEPDRLLSDYIEKEVKYLGQLTSIPGYLNPSSRTEILHFIDNAKRAHQLPGHLTQEHDAVLSLSAYNVKLAWRDGEDIILRVPIHDIAAVSYVRDDAAHLVVLKTDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 14324 - protein, 386 aa, Homo sapiens
  Payload ID: 2772
  Gene Symbol: CCM2
  Gene Name: cerebral cavernous malformation 2
  Uniprot ID: Q9BSQ5
  ENSP ID: ENSP00000444725
MEEEGKKGKKYLGQLTSIPGYLNPSSRTEILHFIDNAKRAHQLPGHLTQEHDAVLSLSAYNVKLAWRDGEDIILRVPIHDIAAVSYVRDDAAHLVVLKTAQDPGISPSQSLCAESSRGLSAGSLSESAVGPVEACCLVILAAESKVAAEELCCLLGQVFQVVYTESTIDFLDRAIFDGASTPTHHLSLHSDDSSTKVDIKETYEVEASTFCFPESVDVGGASPHSKTISESELSASATELLQDYMLTLRTKLSSQEIQQFAALLHEYRNGASIHEFCINLRQLYGDSRKFLLLGLRPFIPEKDSQHFENFLETIGVKDGRGIITDSFGRHRRALSTTSSSTTNGNRATGSSDDRSAPSEGDEWDRMISDISSDIEALGCSMDQDSA

SEQ ID NO: 14325 - protein, 433 aa, Homo sapiens
  Payload ID: 2773
  Gene Symbol: CCM2L
  Gene Name: cerebral cavernous malformation 2-like
  Uniprot ID: Q9NUG4
  ENSP ID: ENSP00000262659
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEARAGGGGGGSLERQRAGARASGSWERRQTFSGSWERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRIMAPRTPLKHVTAARPHLLSMAPTAAAATTAVWAWSSYRITWSRCGVSWGPSRSSSLRCCCGSTGWGCPSRTIAQAC

SEQ ID NO: 14326 - protein, 324 aa, Homo sapiens
  Payload ID: 2773
  Gene Symbol: CCM2L
  Gene Name: cerebral cavernous malformation 2-like
  ENSP ID: ENSP00000392448
ERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRSESCHTDGTYAYDADFSCCSSFNGSQDTFEACYSGTSTPSFHGSHCSGSDHSSLGLEQLQDYMVTLRSKLGPLEIQQFAMLLREYRLGLPIQDYCTGLLKLYGDRRKFLLLGMRPFIPDQDIGYFEGFLEGVGIREGGILTDSFGRIKRSMSSTSASAVRSYDGAAQRPEAQAFHRLLADITHDIEALAPDDDDDDEDEPRGSRGGSDAAEDNYL

SEQ ID NO: 14327 - protein, 85 aa, Homo sapiens
  Payload ID: 2774
  Gene Symbol: CDNF
  Gene Name: cerebral dopamine neurotrophic factor
  Uniprot ID: Q49AH0
  ENSP ID: ENSP00000367703
MSVHMPAMKICEKLKKLDSQICELKYEKTLDLASVDLRKMRVAELKQILHSWGEECRACAEKTDYVNLIQELAPKYAATHPKTEL

SEQ ID NO: 14328 - protein, 187 aa, Homo sapiens
  Payload ID: 2774
  Gene Symbol: CDNF
  Gene Name: cerebral dopamine neurotrophic factor
  Uniprot ID: Q49AH0
  ENSP ID: ENSP00000419395
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 14329 - protein, 595 aa, Homo sapiens
  Payload ID: 2775
  Gene Symbol: CERCAM
  Gene Name: cerebral endothelial cell adhesion molecule
  Uniprot ID: Q5T4B2
  ENSP ID: ENSP00000361929
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 14330 - protein, 517 aa, Homo sapiens
  Payload ID: 2775
  Gene Symbol: CERCAM
  Gene Name: cerebral endothelial cell adhesion molecule
  Uniprot ID: Q5T4B2
  ENSP ID: ENSP00000361933
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 14331 - protein, 64 aa, Homo sapiens
  Payload ID: 2775
  Gene Symbol: CERCAM
  Gene Name: cerebral endothelial cell adhesion molecule
  ENSP ID: ENSP00000402508
MLQEWLAAVGDDYAAVVWRPEGEPRFYPDEEGPKHWTKERHQFLMELKQEALTFARNWGADYIL

SEQ ID NO: 14332 - protein, 109 aa, Homo sapiens
  Payload ID: 2775
  Gene Symbol: CERCAM
  Gene Name: cerebral endothelial cell adhesion molecule
  ENSP ID: ENSP00000402928
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQ

SEQ ID NO: 14333 - protein, 79 aa, Homo sapiens
  Payload ID: 2775
  Gene Symbol: CERCAM
  Gene Name: cerebral endothelial cell adhesion molecule
  ENSP ID: ENSP00000403766
MLQEWLAAVGDDYAAVVWRPEGEPRFYPDEEGPKHWTKERHQFLMELKQEALTFARNWGADYILFADTDNILTNNQTLR

SEQ ID NO: 14334 - protein, 218 aa, Homo sapiens
  Payload ID: 2775
  Gene Symbol: CERCAM
  Gene Name: cerebral endothelial cell adhesion molecule
  ENSP ID: ENSP00000416676
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALG

SEQ ID NO: 14335 - protein, 155 aa, Homo sapiens
  Payload ID: 2775
  Gene Symbol: CERCAM
  Gene Name: cerebral endothelial cell adhesion molecule
  ENSP ID: ENSP00000478713
MTAKQCPGAGHYCPESRGGGCWQGLQILSDLATTLGMATLPSGPVFHREKPLRDGSHSLKVSQQRSRTPRPLYPAWPDSGPCGPQLVSSWADPRIPSLPKDSAEGPLCPFYLHLSTLPQLDVWVSPAPSSLAGAKYREVKQDPCRHVAQHTVGPQ

SEQ ID NO: 14336 - protein, 517 aa, Homo sapiens [sequence omitted]

SEQ ID NO: 14337 - protein, 414 aa, Homo sapiens
  Payload ID: 2776
  Gene Symbol: CLN3
  Gene Name: ceroid-lipofuscinosis, neuronal 3
  Uniprot ID: Q13286
  ENSP ID: ENSP00000329171
MGGCAGSRRRFSDSEGEETVPEPRLPLLDHQGAHWKNAVGFWLLGLCNNFSYVVMLSAAHDILSHKRTSGNQSHAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14338 - protein, 181 aa, Homo sapiens
  Payload ID: 2776
  Gene Symbol: CLN3
  Gene Name: ceroid-lipofuscinosis, neuronal 3
  ENSP ID: ENSP00000347660
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCAISCCSHLLRPRTLEGKKKQRAQPGSPS

SEQ ID NO: 14339 - protein, 339 aa, Homo sapiens
  Payload ID: 2776
  Gene Symbol: CLN3
  Gene Name: ceroid-lipofuscinosis, neuronal 3
  Uniprot ID: Q13286
  ENSP ID: ENSP00000350457
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14340 - protein, 384 aa, Homo sapiens
  Payload ID: 2776
  Gene Symbol: CLN3
  Gene Name: ceroid-lipofuscinosis, neuronal 3
  ENSP ID: ENSP00000350523
MLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14341 - protein, 336 aa, Homo sapiens
  Payload ID: 2776
  Gene Symbol: CLN3
  Gene Name: ceroid-lipofuscinosis, neuronal 3
  ENSP ID: ENSP00000353073
MLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPSYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14342 - protein, 438 aa, Homo sapiens
  Payload ID: 2776
  Gene Symbol: CLN3
  Gene Name: ceroid-lipofuscinosis, neuronal 3
  Uniprot ID: Q13286
  ENSP ID: ENSP00000353116
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14343 - protein, 338 aa, Homo sapiens
  Payload ID: 2776
  Gene Symbol: CLN3
  Gene Name: ceroid-lipofuscinosis, neuronal 3
  ENSP ID: ENSP00000379014
MWTQAQRRSPTTAHHDLTATLSLRLPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14344 - protein, 438 aa, Homo sapiens; identical to SEQ ID NO: 14342
  Payload ID: 2776
  Gene Symbol: CLN3
  Gene Name: ceroid-lipofuscinosis, neuronal 3
  Uniprot ID: Q13286
  ENSP ID: ENSP00000454229

SEQ ID NO: 14345 - protein, 135 aa, Homo sapiens
  Payload ID: 2776
  Gene Symbol: CLN3
  Gene Name: ceroid-lipofuscinosis, neuronal 3
  ENSP ID: ENSP00000454466
  MOD_RES (1)..(1): Any amino acid
XLLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14346 - protein, 253 aa, Homo sapiens
  Payload ID: 2776
  Gene Symbol: CLN3
  Gene Name: ceroid-lipofuscinosis, neuronal 3
  Uniprot ID: Q13286
  ENSP ID: ENSP00000454680
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGSSSSLSLRERWTVFKGLLWYIVPLVVVYFAEYFINQGLFELLFFWNTSLSHAQQYRWYQMLYQAGVFASRSSLRCCRIRFTWALALLQMESRSVAQAGM

SEQ ID NO: 14347 - protein, 175 aa, Homo sapiens
  Payload ID: 2776
  Gene Symbol: CLN3
  Gene Name: ceroid-lipofuscinosis, neuronal 3
  ENSP ID: ENSP00000454899
MGGCAGSRRRFSDSEGEYSRPPSWNDHLWLAAHLRGMRADSAPGGHARSGRAPESRWGSCPLLALPGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPY

SEQ ID NO: 14348 - protein, 181 aa, Homo sapiens; identical to SEQ ID NO: 14338
  Payload ID: 2776
  Gene Symbol: CLN3
  Gene Name: ceroid-lipofuscinosis, neuronal 3
  ENSP ID: ENSP00000455342

SEQ ID NO: 14349 - protein, 74 aa, Homo sapiens
  Payload ID: 2776
  Gene Symbol: CLN3
  Gene Name: ceroid-lipofuscinosis, neuronal 3
  ENSP ID: ENSP00000455365
MGGCAGSRRRFSDSEGEETVPEPRLPLLDHQGAHWKNAVGFWLLGLCNNFSYVVMLSAAHDILSHKRTSGNQSH

SEQ ID NO: 14350 - protein, 341 aa, Homo sapiens
  Payload ID: 2776
  Gene Symbol: CLN3
  Gene Name: ceroid-lipofuscinosis, neuronal 3
  ENSP ID: ENSP00000455387
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLTSDEHREFAMAATCISDTLGISLSGLLALPLHDFLCQLS

SEQ ID NO: 14351 - protein, 132 aa, Homo sapiens
  Payload ID: 2776
  Gene Symbol: CLN3
  Gene Name: ceroid-lipofuscinosis, neuronal 3
  ENSP ID: ENSP00000455549
MWTQAQRRSPTTAHHDLTATLSLRLLCSWRTSSPHSSSNCWLLLAFTCCPTAPGFSSVGFVLLEASSWLPFLILWGPACVVWSSLASHQALGRSPSSPSLPSTPAISCCSHLLRPRTLEGKKKQRAQPGSPS

SEQ ID NO: 14352 - protein, 184 aa, Homo sapiens
  Payload ID: 2776
  Gene Symbol: CLN3
  Gene Name: ceroid-lipofuscinosis, neuronal 3
  ENSP ID: ENSP00000455603
MLSAAHDILSHKRTSGNQSHVDPGPTPIPHNSSSRFDCNSVSTAPPGSRQWDLCCWKLRPGCLFSFCGDQPVCYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSL

SEQ ID NO: 14353 - protein, 181 aa, Homo sapiens; identical to SEQ ID NO: 14338
  Payload ID: 2776
  Gene Symbol: CLN3
  Gene Name: ceroid-lipofuscinosis, neuronal 3
  ENSP ID: ENSP00000456013

SEQ ID NO: 14354 - protein, 421 aa, Homo sapiens
  Payload ID: 2776
  Gene Symbol: CLN3
  Gene Name: ceroid-lipofuscinosis, neuronal 3
  Uniprot ID: Q13286
  ENSP ID: ENSP00000456117
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKVRMMAGFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 14355 - protein, 176 aa, Homo sapiens
  Payload ID: 2776
  Gene Symbol: CLN3
  Gene Name: ceroid-lipofuscinosis, neuronal 3
  ENSP ID: ENSP00000456122
MGGCAGSRRRFSDSEGEETVPEPRLPLLDHQGAHWKNAVGFCPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAP

SEQ ID NO: 14356 - protein, 82 aa, Homo sapiens
  Payload ID: 2776
  Gene Symbol: CLN3
  Gene Name: ceroid-lipofuscinosis, neuronal 3
  ENSP ID: ENSP00000456414
MGGCAGSRRRFSDSEGEETVPEPRLPLLDHQGAHWKNAVGFWLLGLCNNFSYVVMLSAAHDILSHKRTSGNQSHLFLVAHIS

SEQ ID NO: 14357 - protein, 105 aa, Homo sapiens
  Payload ID: 2776
  Gene Symbol: CLN3
  Gene Name: ceroid-lipofuscinosis, neuronal 3
  ENSP ID: ENSP00000456693
MGGCAGSRRRFSDSEGEETVPEPRLPLLDHQGAHWKNAVGFWLCSWRTSSPHSSSNCWLLLAFTCCPTAPGFSSVGFVLLEASSWLPFLILWGPACVLFLVAHIS

SEQ ID NO: 14358 - protein, 120 aa, Homo sapiens
  Payload ID: 2776
  Gene Symbol: CLN3
  Gene Name: ceroid-lipofuscinosis, neuronal 3
  ENSP ID: ENSP00000457615
MWTQAQRRSPTTAHHDLTATLSLRLPRVLVSGICAAGSFVLVAFSHSVGTSLCGVVFASISSGLGEVTFLSLTAFYPRAVISWWSSGTGGAGLLGALSYLGLTQAGLSPQQTLLSMLGIP

SEQ ID NO: 14359 - protein, 167 aa, Homo sapiens
  Payload ID: 2776
  Gene Symbol: CLN3
  Gene Name: ceroid-lipofuscinosis, neuronal 3
  ENSP ID: ENSP00000458015
MGGCAGSRRRFSDSEGEETVPEPRLPLLDHQGAHWKNAVGFWLLGLCNNFSYVVMLSAAHDILSHKRTSGNQSHPPGSRQWDLCCWKLRPGCLFSFCGDQPVCYFLLLTSPEAQDPGGEEEAESAARQPLIRTEAPESKPGSSSSLSLRERWTVFKGLLWYIVPLVV

SEQ ID NO: 14360 - protein, 82 aa, Homo sapiens; identical to SEQ ID NO: 14356
  Payload ID: 2776
  Gene Symbol: CLN3
  Gene Name: ceroid-lipofuscinosis, neuronal 3
  ENSP ID: ENSP00000486178

SEQ ID NO: 14361 - protein, 341 aa, Homo sapiens; identical to SEQ ID NO: 14350
  Payload ID: 2776
  Gene Symbol: CLN3
  Gene Name: ceroid-lipofuscinosis, neuronal 3
  ENSP ID: ENSP00000486616

SEQ ID NO: 14362 - protein, 407 aa, Homo sapiens
  Payload ID: 2777
  Gene Symbol: CLN5
  Gene Name: ceroid-lipofuscinosis, neuronal 5
  ENSP ID: ENSP00000366673
MRRNLRLGPSSGADAQGQGAPRPGLAAPRMLLPPASQASRGSGSTGCSLMAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 14363 - protein, 358 aa, Homo sapiens
  Payload ID: 2777
  Gene Symbol: CLN5
  Gene Name: ceroid-lipofuscinosis, neuronal 5
  Uniprot ID: O75503
  ENSP ID: ENSP00000479547
MAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 14364 - protein, 186 aa, Homo sapiens
  Payload ID: 2777
  Gene Symbol: CLN5
  Gene Name: ceroid-lipofuscinosis, neuronal 5
  ENSP ID: ENSP00000482959
  MOD_RES (1)..(1): Any amino acid
XTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGKL

SEQ ID NO: 14365 - protein, 311 aa, Homo sapiens
  Payload ID: 2778
  Gene Symbol: CLN6
  Gene Name: ceroid-lipofuscinosis, neuronal 6, late infantile, variant
  Uniprot ID: Q9NWW5
  ENSP ID: ENSP00000249806
MEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 14366 - protein, 343 aa, Homo sapiens
  Payload ID: 2778
  Gene Symbol: CLN6
  Gene Name: ceroid-lipofuscinosis, neuronal 6, late infantile, variant
  Uniprot ID: Q9NWW5
  ENSP ID: ENSP00000445770
MAAVAGKERRARGRPRPETLGAIPRREGGEAGLSRAFKPLAQAPLSCETSLRKLKFKGKKHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 14367 - protein, 105 aa, Homo sapiens
  Payload ID: 2778
  Gene Symbol: CLN6
  Gene Name: ceroid-lipofuscinosis, neuronal 6, late infantile, variant
  ENSP ID: ENSP00000454818
MEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKRLLYCL

SEQ ID NO: 14368 - protein, 158 aa, Homo sapiens
  Payload ID: 2778
  Gene Symbol: CLN6
  Gene Name: ceroid-lipofuscinosis, neuronal 6, late infantile, variant
  ENSP ID: ENSP00000457384
MEATRRRQHLGATGGPGAQLGASFLQARYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 14369 - protein, 248 aa, Homo sapiens
  Payload ID: 2778
  Gene Symbol: CLN6
  Gene Name: ceroid-lipofuscinosis, neuronal 6, late infantile, variant
  ENSP ID: ENSP00000457783
MEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 14370 - protein, 213 aa, Homo sapiens
  Payload ID: 2778
  Gene Symbol: CLN6
  Gene Name: ceroid-lipofuscinosis, neuronal 6, late infantile, variant
  ENSP ID: ENSP00000457822
MEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKLIERSPRTLPRSITYVSIIIFIMGASIHLVGDSVNHRLLFSGYQHHLSVRENPIIKNLKPETLVRPPPAPCLSTPLSCSTIMMSTWVTACGTSPSSSSSSCTSAAALLPLKLRA

SEQ ID NO: 14371 - protein, 286 aa, Homo sapiens
  Payload ID: 2779
  Gene Symbol: CLN8
  Gene Name: ceroid-lipofuscinosis, neuronal 8
  Uniprot ID: Q9UBY8
  ENSP ID: ENSP00000328182
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 14372 - protein, 286 aa, Homo sapiens; identical to SEQ ID NO: 14371
  Payload ID: 2779
  Gene Symbol: CLN8
  Gene Name: ceroid-lipofuscinosis, neuronal 8
  Uniprot ID: Q9UBY8
  ENSP ID: ENSP00000482713

SEQ ID NO: 14373 - protein, 177 aa, Homo sapiens
  Payload ID: 2779
  Gene Symbol: CLN8
  Gene Name: ceroid-lipofuscinosis, neuronal 8
  ENSP ID: ENSP00000487905
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSW

SEQ ID NO: 14374 - protein, 171 aa, Homo sapiens
  Payload ID: 2779
  Gene Symbol: CLN8
  Gene Name: ceroid-lipofuscinosis, neuronal 8
  ENSP ID: ENSP00000488211
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTP

SEQ ID NO: 14375 - protein, 80 aa, Homo sapiens
  Payload ID: 2779
  Gene Symbol: CLN8
  Gene Name: ceroid-lipofuscinosis, neuronal 8
  ENSP ID: ENSP00000488606
MNPASDGGTSESIFDLDYASWGIRSTLMVAGFVFYLGVFVVCHQLSSSLNATYRSLVAREKVFWDLAATRAVFGVQSTAA

SEQ ID NO: 14376 - protein, 80 aa, Homo sapiens; identical to SEQ ID NO: 14375
  Payload ID: 2779
  Gene Symbol: CLN8
  Gene Name: ceroid-lipofuscinosis, neuronal 8
  ENSP ID: ENSP00000488898

SEQ ID NO: 14377 - protein, 1065 aa, Homo sapiens
  Payload ID: 2780
  Gene Symbol: CP
  Gene Name: ceruloplasmin (ferroxidase)
  Uniprot ID: P00450
  ENSP ID: ENSP00000264613
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 14378 - protein, 946 aa, Homo sapiens
  Payload ID: 2780
  Gene Symbol: CP
  Gene Name: ceruloplasmin (ferroxidase)
  ENSP ID: ENSP00000418773
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHWTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHLLRLTGEYGM

SEQ ID NO: 14379 - protein, 225 aa, Homo sapiens
  Payload ID: 2780
  Gene Symbol: CP
  Gene Name: ceruloplasmin (ferroxidase)
  ENSP ID: ENSP00000420367
GAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEASSETHRRIWNVIYPITVSVIILFQISTKE

SEQ ID NO: 14380 - protein, 852 aa, Homo sapiens
  Payload ID: 2780
  Gene Symbol: CP
  Gene Name: ceruloplasmin (ferroxidase)
  ENSP ID: ENSP00000420545
VVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVEPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEGEYPDTKSG

SEQ ID NO: 14381 - protein, 178 aa, Homo sapiens
  Payload ID: 2780
  Gene Symbol: CP
  Gene Name: ceruloplasmin (ferroxidase)
  ENSP ID: ENSP00000426888
MKILILGIFLFLCSTPAWAKEKHYYIGIIETTWDYASDHGEKKLISVDTGFQNKWYSEDVTISRPNDQEEITAQILTKKLDNKEHSTLREHSNIYLQNGPDRIGRLYKKALYLQYTDETFRTTIEKPVWLGFLGPIIKAETGDKVYVHLKNLASRPYTFHSHGITYYKEHEGAIYPDN

SEQ ID NO: 14382 - protein, 354 aa, Homo sapiens
  Payload ID: 2781
  Gene Symbol: FIGF
  Gene Name: c-fos induced growth  factor (vascular endothelial growth  factor D)
  Uniprot ID: O43915
  ENSP ID: ENSP00000297904
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 14383 - protein, 167 aa, Homo sapiens
  Payload ID: 2782
  Gene Symbol: CGGBP1
  Gene Name: CGG triplet repeat binding protein 1
  Uniprot ID: Q9UFW8
  ENSP ID: ENSP00000381428
MERFVVTAPPARNRSKTALYVTPLDRVTEFGGELHEDGGKLFCTSCNVVLNHVRKSAISDHLKSKTHTKRKAEFEEQNVRKKQRPLTASLQCNSTAQTEKVSVIQDFVKMCLEANIPLEKADHPAVRAFLSRHVKNGGSIPKSDQLRRAYLPDGYENENQLLNSQDC

SEQ ID NO: 14384 - protein, 167 aa, Homo sapiens; identical to SEQ ID NO: 14383
  Payload ID: 2782
  Gene Symbol: CGGBP1
  Gene Name: CGG triplet repeat binding protein 1
  Uniprot ID: Q9UFW8
  ENSP ID: ENSP00000381429

SEQ ID NO: 14385 - protein, 167 aa, Homo sapiens; identical to SEQ ID NO: 14383
  Payload ID: 2782
  Gene Symbol: CGGBP1
  Gene Name: CGG triplet repeat binding protein 1
  Uniprot ID: Q9UFW8
  ENSP ID: ENSP00000418769

SEQ ID NO: 14386 - protein, 106 aa, Homo sapiens
  Payload ID: 2782
  Gene Symbol: CGGBP1
  Gene Name: CGG triplet repeat binding protein 1
  ENSP ID: ENSP00000419459
MERFVVTAPPARNRSKTALYVTPLDRVTEFGGELHEDGGKLFCTSCNVVLNHVRKSAISDHLKSKTHTKRKAEFEEQNVRKKQRPLTASLQCNSTAQTEKVSVIQD

SEQ ID NO: 14387 - protein, 167 aa, Homo sapiens; identical to SEQ ID NO: 14383
  Payload ID: 2782
  Gene Symbol: CGGBP1
  Gene Name: CGG triplet repeat binding protein 1
  Uniprot ID: Q9UFW8
  ENSP ID: ENSP00000420374

SEQ ID NO: 14388 - protein, 115 aa, Homo sapiens
  Payload ID: 2783
  Gene Symbol: CRCP
  Gene Name: CGRP receptor component
  Uniprot ID: O75575
  ENSP ID: ENSP00000340044
MEVKDANSALLSNYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 14389 - protein, 42 aa, Homo sapiens
  Payload ID: 2783
  Gene Symbol: CRCP
  Gene Name: CGRP receptor component
  ENSP ID: ENSP00000353589
MEVKDANSALLSNYEMESRSVTQAGVQWHHPGSLQPLPPGFK

SEQ ID NO: 14390 - protein, 148 aa, Homo sapiens
  Payload ID: 2783
  Gene Symbol: CRCP
  Gene Name: CGRP receptor component
  Uniprot ID: O75575
  ENSP ID: ENSP00000378736
MEVKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 14391 - protein, 71 aa, Homo sapiens
  Payload ID: 2783
  Gene Symbol: CRCP
  Gene Name: CGRP receptor component
  Uniprot ID: O75575
  ENSP ID: ENSP00000381674
MEVAEKLQLLNHRPVTAVEIQLMVEESEERLTEEQIEALLHTVTSILPAEPEAEQKKNTNSNVAMDEEDPA

SEQ ID NO: 14392 - protein, 141 aa, Homo sapiens
  Payload ID: 2783
  Gene Symbol: CRCP
  Gene Name: CGRP receptor component
  Uniprot ID: O75575
  ENSP ID: ENSP00000388653
MQRGDPGEHLGARSWHLGAVGGGGDSCEVKDANSALLSNYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 14393 - protein, 46 aa, Homo sapiens
  Payload ID: 2784
  Gene Symbol:
  Gene Name: CH17-140K24.5
  ENSP ID: ENSP00000485209
MEIGWMHNRRQSNEEFLNKHKNWAQPFDCVGSHKVALQTEETEEQN

SEQ ID NO: 14394 - protein, 46 aa, Homo sapiens; identical to SEQ ID NO: 14393
  Payload ID: 2784
  Gene Symbol:
  Gene Name: CH17-140K24.5
  ENSP ID: ENSP00000485377

SEQ ID NO: 14395 - protein, 35 aa, Homo sapiens
  Payload ID: 2785
  Gene Symbol:
  Gene Name: CH17-140K24.8
  ENSP ID: ENSP00000485074
MEIRGALDLRKRLSTHRSITASVPSLPEVALTPVP

SEQ ID NO: 14396 - protein, 117 aa, Homo sapiens
  Payload ID: 2786
  Gene Symbol:
  Gene Name: CH17-212P11.5
  ENSP ID: ENSP00000479304
MDCTWRILLLVAAATGTHAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCAT

SEQ ID NO: 14397 - protein, 117 aa, Homo sapiens; identical to SEQ ID NO: 14396
  Payload ID: 2786
  Gene Symbol:
  Gene Name: CH17-212P11.5
  ENSP ID: ENSP00000487714

SEQ ID NO: 14398 - protein, 118 aa, Homo sapiens
  Payload ID: 2787
  Gene Symbol:
  Gene Name: CH17-212P11.6
  ENSP ID: ENSP00000487827
MAPHHGQDLELIFLVAAATGKVQLGQSEAEVKKPGASVKVSCKASGYTFTYCSLHWLQQAPGQGLERMRWITLYNGNTNYAKKFQGRVTITRDMSLRTAYIELSSLRSEDSAVYYWAR

SEQ ID NO: 14399 - protein, 118 aa, Homo sapiens
  Payload ID: 2787
  Gene Symbol:
  Gene Name: CH17-212P11.6
  ENSP ID: ENSP00000488306
MAPHHGQDLELIFLVAAATGKVQLGQSEAEVKKPGASVKVSCKASGYTFTCCSLHWLQQAPGQGLERMRWITLYNGNTNYAKKFQGRVTITRDMSLRTAYIELSSLRSEDSAVYYWAR

SEQ ID NO: 14400 - protein, 117 aa, Homo sapiens
  Payload ID: 2788
  Gene Symbol:
  Gene Name: CH17-224D4.1
  ENSP ID: ENSP00000488230
MEFWLSWVLLVAILKDVQCEVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVK

SEQ ID NO: 14401 - protein, 117 aa, Homo sapiens; identical to SEQ ID NO: 14400
  Payload ID: 2788
  Gene Symbol:
  Gene Name: CH17-224D4.1
  ENSP ID: ENSP00000488609

SEQ ID NO: 14402 - protein, 117 aa, Homo sapiens
  Payload ID: 2789
  Gene Symbol:
  Gene Name: CH17-224D4.2
  ENSP ID: ENSP00000488144
MGSTAILALLLAVLQGVCAEVQLVQSGAEVKKPGESLRISCKGSGYSFTSYWISWVRQMPGKGLEWMGRIDPSDSYTNYSPSFQGHVTISADKSISTAYLQWSSLKASDTAMYYCAR

SEQ ID NO: 14403 - protein, 117 aa, Homo sapiens; identical to SEQ ID NO: 14402
  Payload ID: 2789
  Gene Symbol:
  Gene Name: CH17-224D4.2
  ENSP ID: ENSP00000488587

SEQ ID NO: 14404 - protein, 117 aa, Homo sapiens
  Payload ID: 2790
  Gene Symbol:
  Gene Name: CH17-262H11.1
  ENSP ID: ENSP00000487727
MDWTWRILFLVAAATGAHSQVQLVQSGSELKKPGASVKVSCKASGYTFTSYAMNWVRQAPGQGLEWMGWINTNTGNPTYAQGFTGRFVFSLDTSVSTAYLQICSLKAEDTAVYYCAR

SEQ ID NO: 14405 - protein, 117 aa, Homo sapiens; identical to SEQ ID NO: 14404
  Payload ID: 2790
  Gene Symbol:
  Gene Name: CH17-262H11.1
  ENSP ID: ENSP00000488259

SEQ ID NO: 14406 - protein, 43 aa, Homo sapiens
  Payload ID: 2791
  Gene Symbol:
  Gene Name: CH17-270A2.2
  ENSP ID: ENSP00000487094
MSGPIDNAIDWNPDWRRLPRELKIRVRKLQKERITILLPKRPP

SEQ ID NO: 14407 - protein, 232 aa, Homo sapiens; identical to SEQ ID NO: 1177
  Payload ID: 2792
  Gene Symbol:
  Gene Name: CH17-5A7.1
  ENSP ID: ENSP00000481688

SEQ ID NO: 14408 - protein, 153 aa, Homo sapiens; identical to SEQ ID NO: 1173
  Payload ID: 2792
  Gene Symbol:
  Gene Name: CH17-5A7.1
  ENSP ID: ENSP00000484554

SEQ ID NO: 14409 - protein, 218 aa, Homo sapiens
  Payload ID: 2792
  Gene Symbol:
  Gene Name: CH17-5A7.1
  ENSP ID: ENSP00000487831
  MOD_RES (1)..(1): Any amino acid
XTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNCVAQKHLHPHPVGPPSNILSIRGSVFVIANGP

SEQ ID NO: 14410 - protein, 369 aa, Homo sapiens; identical to SEQ ID NO: 1174
  Payload ID: 2792
  Gene Symbol:
  Gene Name: CH17-5A7.1
  ENSP ID: ENSP00000487876

SEQ ID NO: 14411 - protein, 232 aa, Homo sapiens; identical to SEQ ID NO: 1177
  Payload ID: 2792
  Gene Symbol:
  Gene Name: CH17-5A7.1
  ENSP ID: ENSP00000487986

SEQ ID NO: 14412 - protein, 118 aa, Homo sapiens
  Payload ID: 2793
  Gene Symbol:
  Gene Name: CH17-60O17.5
  ENSP ID: ENSP00000480975
MKHLWFFLLLVAAPRWVLSQLQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAR

SEQ ID NO: 14413 - protein, 116 aa, Homo sapiens
  Payload ID: 2793
  Gene Symbol:
  Gene Name: CH17-60O17.5
  ENSP ID: ENSP00000488126
MKHLWFFLLLVAAPRWVLSQLQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYC

SEQ ID NO: 14414 - protein, 117 aa, Homo sapiens
  Payload ID: 2794
  Gene Symbol:
  Gene Name: CH17-60O17.7
  ENSP ID: ENSP00000488753
MEFGLSWVFLVALLRGVQCQVQLVESGGGVVQPGGSLRLSCAASGFTFSSYGMHWVRQAPGKGLEWVAFIRYDGSNKYYADSVKGRFTISRDNSKNTLYLQMNSLRAEDTAVYYCAK

SEQ ID NO: 14415 - protein, 783 aa, Homo sapiens
  Payload ID: 2795
  Gene Symbol:
  Gene Name: CH507-42P11.8
  ENSP ID: ENSP00000482829
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQGLKAFRQQLRKTTRTKGFLGLNKIKGLARQVCQVPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 14416 - protein, 309 aa, Homo sapiens
  Payload ID: 2796
  Gene Symbol:
  Gene Name: CH507-9B2.1
  ENSP ID: ENSP00000483732
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTESWNLLLLLS

SEQ ID NO: 14417 - protein, 192 aa, Homo sapiens
  Payload ID: 2796
  Gene Symbol:
  Gene Name: CH507-9B2.1
  ENSP ID: ENSP00000484302
MRLGSPGLLFLLFSSLRAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTESWNLLLLLS

SEQ ID NO: 14418 - protein, 302 aa, Homo sapiens
  Payload ID: 2796
  Gene Symbol:
  Gene Name: CH507-9B2.1
  ENSP ID: ENSP00000485129
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 14419 - protein, 77 aa, Homo sapiens
  Payload ID: 2796
  Gene Symbol:
  Gene Name: CH507-9B2.1
  ENSP ID: ENSP00000485557
MRLGSPGLLFLLFSSLRAEQLLGKRGQPLPEPSPDVTGRHAAGRLLPALVQRHPPGRAEVSLPGVEPIPGIPGGFER

SEQ ID NO: 14420 - protein, 185 aa, Homo sapiens
  Payload ID: 2796
  Gene Symbol:
  Gene Name: CH507-9B2.1
  ENSP ID: ENSP00000485649
MRLGSPGLLFLLFSSLRAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 14421 - protein, 155 aa, Homo sapiens
  Payload ID: 2797
  Gene Symbol:
  Gene Name: CH507-9B2.2
  ENSP ID: ENSP00000485664
VEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 14422 - protein, 15 aa, Homo sapiens
  Payload ID: 2798
  Gene Symbol:
  Gene Name: CH507-9B2.3
  ENSP ID: ENSP00000487345
MYHFLKQSCLLSSWD

SEQ ID NO: 14423 - protein, 279 aa, Homo sapiens
  Payload ID: 2799
  Gene Symbol:
  Gene Name: CH507-9B2.4
  ENSP ID: ENSP00000485630
  MOD_RES (1)..(1): Any amino acid
XEVVTSSLPELYVEKVLEFLASSFEVSRHLEFYLLWTHKLLMLHGQKLKSRAGTLLPVIQFLQKSIQRHLDDLSKLILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 14424 - protein, 919 aa, Homo sapiens
  Payload ID: 2800
  Gene Symbol:
  Gene Name: CH507-9B2.5
  ENSP ID: ENSP00000482107
MKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 14425 - protein, 79 aa, Homo sapiens
  Payload ID: 2800
  Gene Symbol:
  Gene Name: CH507-9B2.5
  ENSP ID: ENSP00000488213
EFLNRRKMTEFGNLALIDQDAGQEDGVAIPLPGVRKGDMSSRHFKPEIRVTSLRFSPTVIRAALSRCSRDHRACGAEDA

SEQ ID NO: 14426 - protein, 203 aa, Homo sapiens
  Payload ID: 2801
  Gene Symbol:
  Gene Name: CH507-9B2.9
  ENSP ID: ENSP00000485615
TLYNVKAEIFPPSGMEYCRTGSLCSLEVLITRLSDLLEVDKDEALTESDEHFSTKLMYEVVDNSSNWAVCGKSCGVISMPVAARATHRVHMEVMPLFAGYLPLPDVRLFKYLPHHSAHSSQLDADSWIENDSLSVDKHGDDQPDSSSLKSRGSVHSACSSEHKGLPMPRLQALPAGQVFNSSSGTQVLVIPSQDDHVLEVSVT

SEQ ID NO: 14427 - protein, 219 aa, Homo sapiens
  Payload ID: 2802
  Gene Symbol: CHAC1
  Gene Name: ChaC glutathione-specific gamma-glutamylcyclotransferase 1
  Uniprot ID: Q9BUX1
  ENSP ID: ENSP00000395466
MGGAQLELPSGARPGVCVRRSFRAHAGDQPRRPPGPIPVPGTMKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQNPGYLGPAPEEAIATQILACRGFSGHNLEYLLRLADFMQLCGPQAQDEHLAAIVDAVGTMLPCFCPTEQALALV

SEQ ID NO: 14428 - protein, 264 aa, Homo sapiens
  Payload ID: 2802
  Gene Symbol: CHAC1
  Gene Name: ChaC glutathione-specific gamma-glutamylcyclotransferase 1
  Uniprot ID: Q9BUX1
  ENSP ID: ENSP00000398105
MGGAQLELPSGARPGVCVRRSFRAHAGDQPRRPPGPIPVPGTMKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQVSKALKYLNVREAVLGGYDTKEVTFYPQDAPDQPLKALAYVATPQNPGYLGPAPEEAIATQILACRGFSGHNLEYLLRLADFMQLCGPQAQDEHLAAIVDAVGTMLPCFCPTEQALALV

SEQ ID NO: 14429 - protein, 37 aa, Homo sapiens
  Payload ID: 2802
  Gene Symbol: CHAC1
  Gene Name: ChaC glutathione-specific gamma-glutamylcyclotransferase 1
  ENSP ID: ENSP00000452707
MQLCGPQAQDEHLAAIVDAVGTMLPCFCPTEQALALV

SEQ ID NO: 14430 - protein, 222 aa, Homo sapiens
  Payload ID: 2802
  Gene Symbol: CHAC1
  Gene Name: ChaC glutathione-specific gamma-glutamylcyclotransferase 1
  ENSP ID: ENSP00000481816
MKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQVSKALKYLNVREAVLGGYDTKEVTFYPQDAPDQPLKALAYVATPQNPGYLGPAPEEAIATQILACRGFSGHNLEYLLRLADFMQLCGPQAQDEHLAAIVDAVGTMLPCFCPTEQALALV

SEQ ID NO: 14431 - protein, 264 aa, Homo sapiens; identical to SEQ ID NO: 14428
  Payload ID: 2802
  Gene Symbol: CHAC1
  Gene Name: ChaC glutathione-specific gamma-glutamylcyclotransferase 1
  Uniprot ID: Q9BUX1
  ENSP ID: ENSP00000484644

SEQ ID NO: 14432 - protein, 184 aa, Homo sapiens
  Payload ID: 2803
  Gene Symbol: CHAC2
  Gene Name: ChaC, cation transport regulator homolog 2 (E. coli)
  Uniprot ID: Q8WUX2
  ENSP ID: ENSP00000295304
MWVFGYGSLIWKVDFPYQDKLVGYITNYSRRFWQGSTDHRGVPGKPGRVVTLVEDPAGCVWGVAYRLPVGKEEEVKAYLDFREKGGYRTTTVIFYPKDPTTKPFSVLLYIGTCDNPDYLGPAPLEDIAEQIFNAAGPSGRNTEYLFELANSIRNLVPEEADEHLFALEKLVKERLEGKQNLNCI

SEQ ID NO: 14433 - protein, 535 aa, Homo sapiens
  Payload ID: 2804
  Gene Symbol: CCT2
  Gene Name: chaperonin containing TCP1, subunit 2 (beta)
  Uniprot ID: P78371
  ENSP ID: ENSP00000299300
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 14434 - protein, 530 aa, Homo sapiens
  Payload ID: 2804
  Gene Symbol: CCT2
  Gene Name: chaperonin containing TCP1, subunit 2 (beta)
  ENSP ID: ENSP00000441847
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLGNVSLITTPVKHSHVLSIFGPVSSKVVFERYSIKEDCGICLSVPIISLSLDI

SEQ ID NO: 14435 - protein, 488 aa, Homo sapiens
  Payload ID: 2804
  Gene Symbol: CCT2
  Gene Name: chaperonin containing TCP1, subunit 2 (beta)
  Uniprot ID: P78371
  ENSP ID: ENSP00000445471
MDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 14436 - protein, 416 aa, Homo sapiens
  Payload ID: 2804
  Gene Symbol: CCT2
  Gene Name: chaperonin containing TCP1, subunit 2 (beta)
  ENSP ID: ENSP00000450153
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGVANHHS

SEQ ID NO: 14437 - protein, 545 aa, Homo sapiens
  Payload ID: 2805
  Gene Symbol: CCT3
  Gene Name: chaperonin containing TCP1, subunit 3 (gamma)
  Uniprot ID: P49368
  ENSP ID: ENSP00000295688
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 14438 - protein, 40 aa, Homo sapiens
  Payload ID: 2805
  Gene Symbol: CCT3
  Gene Name: chaperonin containing TCP1, subunit 3 (gamma)
  ENSP ID: ENSP00000357241
MMGHRPVLVLNYCRYHPNMFGTQVHDEDAFGPNGRHCDDQ

SEQ ID NO: 14439 - protein, 507 aa, Homo sapiens
  Payload ID: 2805
  Gene Symbol: CCT3
  Gene Name: chaperonin containing TCP1, subunit 3 (gamma)
  Uniprot ID: P49368
  ENSP ID: ENSP00000357242
MMGHRPVLVLSQNTKRESGRKVQSGNINAAKIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 14440 - protein, 54 aa, Homo sapiens
  Payload ID: 2805
  Gene Symbol: CCT3
  Gene Name: chaperonin containing TCP1, subunit 3 (gamma)
  ENSP ID: ENSP00000357245
MMGHRPVLVLKTEFHHVDQAGLQLLMSSGDPPTSASQSAEITGVSHRARSLIFF

SEQ ID NO: 14441 - protein, 188 aa, Homo sapiens
  Payload ID: 2805
  Gene Symbol: CCT3
  Gene Name: chaperonin containing TCP1, subunit 3 (gamma)
  ENSP ID: ENSP00000388799
MYEGDLEGQSMNWTSEEGRGDIIRSGTNIDRAWQCQNTKRESGRKVQSGNINAAKIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVE

SEQ ID NO: 14442 - protein, 276 aa, Homo sapiens
  Payload ID: 2805
  Gene Symbol: CCT3
  Gene Name: chaperonin containing TCP1, subunit 3 (gamma)
  ENSP ID: ENSP00000413308
MYEGDLEGQSMNWTSEEGRGDIIRSGTNIDRAWQCQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGES

SEQ ID NO: 14443 - protein, 161 aa, Homo sapiens
  Payload ID: 2805
  Gene Symbol: CCT3
  Gene Name: chaperonin containing TCP1, subunit 3 (gamma)
  ENSP ID: ENSP00000413431
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILESHSVTMLECGGAILAHCNLCLPAGEMLSVAEHFLEQQMHPTVVISAYRKALDDMISTLK

SEQ ID NO: 14444 - protein, 500 aa, Homo sapiens
  Payload ID: 2805
  Gene Symbol: CCT3
  Gene Name: chaperonin containing TCP1, subunit 3 (gamma)
  ENSP ID: ENSP00000431543
MMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 14445 - protein, 234 aa, Homo sapiens
  Payload ID: 2805
  Gene Symbol: CCT3
  Gene Name: chaperonin containing TCP1, subunit 3 (gamma)
  ENSP ID: ENSP00000434232
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKN

SEQ ID NO: 14446 - protein, 144 aa, Homo sapiens
  Payload ID: 2805
  Gene Symbol: CCT3
  Gene Name: chaperonin containing TCP1, subunit 3 (gamma)
  ENSP ID: ENSP00000434481
MIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKD

SEQ ID NO: 14447 - protein, 154 aa, Homo sapiens
  Payload ID: 2805
  Gene Symbol: CCT3
  Gene Name: chaperonin containing TCP1, subunit 3 (gamma)
  ENSP ID: ENSP00000435026
MMGHRPVLVLSQNTKRESGRKVQSGNINAAKTIADIIRTCLGPKSMMKIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNI

SEQ ID NO: 14448 - protein, 539 aa, Homo sapiens
  Payload ID: 2806
  Gene Symbol: CCT4
  Gene Name: chaperonin containing TCP1, subunit 4 (delta)
  Uniprot ID: P50991
  ENSP ID: ENSP00000377958
MPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 14449 - protein, 509 aa, Homo sapiens
  Payload ID: 2806
  Gene Symbol: CCT4
  Gene Name: chaperonin containing TCP1, subunit 4 (delta)
  Uniprot ID: P50991
  ENSP ID: ENSP00000443061
MPENVAPRSGATAGAAGGRGKGAYQDRDKPAQIRFSNISAAKAVADAIRTSLGPKGMDKMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGEKTAGINVRKGGISNILEELVVQPLLVSVSALTLATETVRSILKIDDVVNTR

SEQ ID NO: 14450 - protein, 541 aa, Homo sapiens
  Payload ID: 2807
  Gene Symbol: CCT5
  Gene Name: chaperonin containing TCP1, subunit 5 (epsilon)
  Uniprot ID: P48643
  ENSP ID: ENSP00000280326
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 14451 - protein, 62 aa, Homo sapiens
  Payload ID: 2807
  Gene Symbol: CCT5
  Gene Name: chaperonin containing TCP1, subunit 5 (epsilon)
  ENSP ID: ENSP00000422744
  MOD_RES (1)..(1): Any amino acid
XAFDEYGRPFLIIKDQDRKSRLMGLEALKSHIMAAKAVANTMRTSLGPNDCQADGGTVQVSG

SEQ ID NO: 14452 - protein, 448 aa, Homo sapiens
  Payload ID: 2807
  Gene Symbol: CCT5
  Gene Name: chaperonin containing TCP1, subunit 5 (epsilon)
  Uniprot ID: P48643
  ENSP ID: ENSP00000423052
MAAKAVANTMRTSLGPNVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 14453 - protein, 88 aa, Homo sapiens
  Payload ID: 2807
  Gene Symbol: CCT5
  Gene Name: chaperonin containing TCP1, subunit 5 (epsilon)
  ENSP ID: ENSP00000423087
VRKLLGPPEKGKCILASVAVSAGWGEVIPVVAPWRPWGPSPSMNMGALSSSSRIRTASPVLWDLRPSSLRMMKLEMEPQEWLSWLVPC

SEQ ID NO: 14454 - protein, 520 aa, Homo sapiens
  Payload ID: 2807
  Gene Symbol: CCT5
  Gene Name: chaperonin containing TCP1, subunit 5 (epsilon)
  ENSP ID: ENSP00000423318
MNSSLGPTIEKLSVSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 14455 - protein, 44 aa, Homo sapiens
  Payload ID: 2807
  Gene Symbol: CCT5
  Gene Name: chaperonin containing TCP1, subunit 5 (epsilon)
  ENSP ID: ENSP00000425751
MASMGTLAFDEYGRPFLIIKDQDRKSRLMGLEALKGQQLSPTDG

SEQ ID NO: 14456 - protein, 486 aa, Homo sapiens
  Payload ID: 2807
  Gene Symbol: CCT5
  Gene Name: chaperonin containing TCP1, subunit 5 (epsilon)
  ENSP ID: ENSP00000426923
MASMGTLAFDEYGRPFLIIKDQDRKSRLMGLEALKSHIMAAKAVANTMRTSLGPNVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 14457 - protein, 503 aa, Homo sapiens
  Payload ID: 2807
  Gene Symbol: CCT5
  Gene Name: chaperonin containing TCP1, subunit 5 (epsilon)
  ENSP ID: ENSP00000427297
MAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 14458 - protein, 44 aa, Homo sapiens; identical to SEQ ID NO: 14455
  Payload ID: 2807
  Gene Symbol: CCT5
  Gene Name: chaperonin containing TCP1, subunit 5 (epsilon)
  ENSP ID: ENSP00000487128

SEQ ID NO: 14459 - protein, 531 aa, Homo sapiens
  Payload ID: 2808
  Gene Symbol: CCT6A
  Gene Name: chaperonin containing TCP1, subunit 6A (zeta 1)
  Uniprot ID: P40227
  ENSP ID: ENSP00000275603
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 14460 - protein, 486 aa, Homo sapiens
  Payload ID: 2808
  Gene Symbol: CCT6A
  Gene Name: chaperonin containing TCP1, subunit 6A (zeta 1)
  Uniprot ID: P40227
  ENSP ID: ENSP00000352019
MAAVKTLNPKAEVARAQAALAVNISAARGLQDVLRTNLGPKGTMKMLVSGAGDIKLTKDGNVLLHEMGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 14461 - protein, 530 aa, Homo sapiens
  Payload ID: 2809
  Gene Symbol: CCT6B
  Gene Name: chaperonin containing TCP1, subunit 6B (zeta 2)
  Uniprot ID: Q92526
  ENSP ID: ENSP00000327191
MAAIKAVNSKAEVARARAALAVNICAARGLQDVLRTNLGPKGTMKMLVSGAGDIKLTKDGNVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 14462 - protein, 493 aa, Homo sapiens
  Payload ID: 2809
  Gene Symbol: CCT6B
  Gene Name: chaperonin containing TCP1, subunit 6B (zeta 2)
  Uniprot ID: Q92526
  ENSP ID: ENSP00000398044
MAAIKAVNSKAEVARARAALAVNICAARGLQDVLRTNLGPKGTMKMLVSGAGDIKLTKDGNVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 14463 - protein, 485 aa, Homo sapiens
  Payload ID: 2809
  Gene Symbol: CCT6B
  Gene Name: chaperonin containing TCP1, subunit 6B (zeta 2)
  Uniprot ID: Q92526
  ENSP ID: ENSP00000400917
MAAIKAVNSKAEVARARAALAVNICAARGLQDVLRTNLGPKGTMKMLVSGAGDIKLTKDGNVLLDEMGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 14464 - protein, 128 aa, Homo sapiens
  Payload ID: 2809
  Gene Symbol: CCT6B
  Gene Name: chaperonin containing TCP1, subunit 6B (zeta 2)
  ENSP ID: ENSP00000462020
MKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDR

SEQ ID NO: 14465 - protein, 543 aa, Homo sapiens
  Payload ID: 2810
  Gene Symbol: CCT7
  Gene Name: chaperonin containing TCP1, subunit 7 (eta)
  Uniprot ID: Q99832
  ENSP ID: ENSP00000258091
MMPTPVILLKEGTDSSQGIPQLVSNISACQVIAEAVRTTLGPRGMDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 14466 - protein, 339 aa, Homo sapiens
  Payload ID: 2810
  Gene Symbol: CCT7
  Gene Name: chaperonin containing TCP1, subunit 7 (eta)
  Uniprot ID: Q99832
  ENSP ID: ENSP00000381456
MMDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 14467 - protein, 83 aa, Homo sapiens
  Payload ID: 2810
  Gene Symbol: CCT7
  Gene Name: chaperonin containing TCP1, subunit 7 (eta)
  ENSP ID: ENSP00000386978
MMPTPVILLKEGTDSSQGIPQLVSNISACQVIAEAVRTTLGPRGMDKLIVDGRVSEAGETLCGGRFTPPDHHSSFPHSHPAGS

SEQ ID NO: 14468 - protein, 98 aa, Homo sapiens
  Payload ID: 2810
  Gene Symbol: CCT7
  Gene Name: chaperonin containing TCP1, subunit 7 (eta)
  ENSP ID: ENSP00000412996
MDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVT

SEQ ID NO: 14469 - protein, 499 aa, Homo sapiens
  Payload ID: 2810
  Gene Symbol: CCT7
  Gene Name: chaperonin containing TCP1, subunit 7 (eta)
  Uniprot ID: Q99832
  ENSP ID: ENSP00000437824
MDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 14470 - protein, 456 aa, Homo sapiens
  Payload ID: 2810
  Gene Symbol: CCT7
  Gene Name: chaperonin containing TCP1, subunit 7 (eta)
  Uniprot ID: Q99832
  ENSP ID: ENSP00000442058
MMVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 14471 - protein, 83 aa, Homo sapiens [sequence omitted]

SEQ ID NO: 14472 - protein, 548 aa, Homo sapiens
  Payload ID: 2811
  Gene Symbol: CCT8
  Gene Name: chaperonin containing TCP1, subunit 8 (theta)
  Uniprot ID: P50990
  ENSP ID: ENSP00000286788
MALHVPKAPGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 14473 - protein, 107 aa, Homo sapiens
  Payload ID: 2811
  Gene Symbol: CCT8
  Gene Name: chaperonin containing TCP1, subunit 8 (theta)
  ENSP ID: ENSP00000407748
  MOD_RES (1)..(1): Any amino acid
XEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 14474 - protein, 323 aa, Homo sapiens
  Payload ID: 2811
  Gene Symbol: CCT8
  Gene Name: chaperonin containing TCP1, subunit 8 (theta)
  ENSP ID: ENSP00000416832
  MOD_RES (1)..(1): Any amino acid
XGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVL

SEQ ID NO: 14475 - protein, 475 aa, Homo sapiens
  Payload ID: 2811
  Gene Symbol: CCT8
  Gene Name: chaperonin containing TCP1, subunit 8 (theta)
  Uniprot ID: P50990
  ENSP ID: ENSP00000442730
MDQMVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 14476 - protein, 529 aa, Homo sapiens
  Payload ID: 2811
  Gene Symbol: CCT8
  Gene Name: chaperonin containing TCP1, subunit 8 (theta)
  Uniprot ID: P50990
  ENSP ID: ENSP00000486921
MHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 14477 - protein, 557 aa, Homo sapiens
  Payload ID: 2812
  Gene Symbol: CCT8L2
  Gene Name: chaperonin containing TCP1, subunit 8 (theta)-like 2
  Uniprot ID: Q96SF2
  ENSP ID: ENSP00000353048
MDSTVPSALELPQRLALNPRESPRSPEEEEPHLLSSLAAVQTLASVIRPCYGPHGRQKFLVTMKGETVCTGCATAILRALELEHPAAWLLREAGQTQAENSGDGTAFVVLLTEALLEQAEQLLKAGLPRPQLREAYATATAEVLATLPSLAIQSLGPLEDPSWALHSVMNTHTLSPMDHLTKLVAHACWAIKELDGSFKPERVGVCALPGGTLEDSCLLPGLAISGKLCGQMATVLSGARVALFACPFGPAHPNAPATARLSSPADLAQFSKGSDQLLEKQVGQLAAAGINVAVVLGEVDEETLTLADKYGIVVIQARSWMEIIYLSEVLDTPLLPRLLPPQRPGKCQRVYRQELGDGLAVVFEWECTGTPALTVVLRGATTQGLRSAEQAVYHGIDAYFQLCQDPRLIPGAGATEMALAKMLSDKGSRLEGPSGPAFLAFAWALKYLPKTLAENAGLAVSDVMAEMSGVHQGGNLLMGVGTEGIINVAQEGVWDTLIVKAQGFRAVAEVVLQLVTVDEIVVAKKSPTHQEIWNPDSKKTKKHPPPVETKKILGLNN

SEQ ID NO: 14478 - protein, 142 aa, Homo sapiens
  Payload ID: 2813
  Gene Symbol: CLC
  Gene Name: Charcot-Leyden crystal galectin
  Uniprot ID: Q05315
  ENSP ID: ENSP00000221804
MSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 14479 - protein, 196 aa, Homo sapiens
  Payload ID: 2814
  Gene Symbol: CHMP1A
  Gene Name: charged multivesicular body protein 1A
  Uniprot ID: Q9HD42
  ENSP ID: ENSP00000380998
MDDTLFQLKFTAKQLEKLAKKAEKDSKAEQAKVKKALLQKNVECARVYAENAIRKKNEGVNWLRMASRVDAVASKVQTAVTMKGVTKNMAQVTKALDKALSTMDLQKVSSVMDRFEQQVQNLDVHTSVMEDSMSSATTLTTPQEQVDSLIMQIAEENGLEVLDQLSQLPEGASAVGESSVRSQEDQLSRRLAALRN

SEQ ID NO: 14480 - protein, 132 aa, Homo sapiens
  Payload ID: 2814
  Gene Symbol: CHMP1A
  Gene Name: charged multivesicular body protein 1A
  ENSP ID: ENSP00000442120
MASRVDAVASKVQTAVTMKGVTKNMAQVTKALDKALSTMDLQKVSSVMDRFEQQVQNLDVHTSVMEDSMSSATTLTTPQEQVDSLIMQIAEENGLEVLDQLSQLPEGASAVGESSVRSQEDQLSRRLAALRN

SEQ ID NO: 14481 - protein, 181 aa, Homo sapiens
  Payload ID: 2814
  Gene Symbol: CHMP1A
  Gene Name: charged multivesicular body protein 1A
  ENSP ID: ENSP00000447899
MDDTLFQLKFTAKQLEKLAKKAEKDSKAEQAKVKKALLQKNVECARVYAENAIRKKNEGVNWLRMASRVDAVASKVQTAVTMKGVTKNMAQVTKALDKALSTMDLQKVSSVMDRFEQQVQNLDVHTSVCGPYPWGCGLGTRSVCGQLIGRGGSQADVLSLHTCGCSLTSPSILCAGSLPGP

SEQ ID NO: 14482 - protein, 187 aa, Homo sapiens
  Payload ID: 2814
  Gene Symbol: CHMP1A
  Gene Name: charged multivesicular body protein 1A
  ENSP ID: ENSP00000449243
MDDTLFQLKFTAKQLEKLAKKAEKDSKAEQAKVKKALLQKNVECARVYAENAIRKKNEGVNWLRMASRVDAVASKVTKNMAQVTKALDKALSTMDLQKVSSVMDRFEQQVQNLDVHTSVMEDSMSSATTLTTPQEQVDSLIMQIAEENGLEVLDQLSQLPEGASAVGESSVRSQEDQLSRRLAALRN

SEQ ID NO: 14483 - protein, 199 aa, Homo sapiens
  Payload ID: 2815
  Gene Symbol: CHMP1B
  Gene Name: charged multivesicular body protein 1B
  Uniprot ID: Q7LBR1
  ENSP ID: ENSP00000432279
MSNMEKHLFNLKFAAKELSRSAKKCDKEEKAEKAKIKKAIQKGNMEVARIHAENAIRQKNQAVNFLRMSARVDAVAARVQTAVTMGKVTKSMAGVVKSMDATLKTMNLEKISALMDKFEHQFETLDVQTQQMEDTMSSTTTLTTPQNQVDMLLQEMADEAGLDLNMELPQGQTGSVGTSVASAEQDELSQRLARLRDQV

SEQ ID NO: 14484 - protein, 222 aa, Homo sapiens
  Payload ID: 2816
  Gene Symbol: CHMP2A
  Gene Name: charged multivesicular body protein 2A
  Uniprot ID: O43633
  ENSP ID: ENSP00000310440
MDLLFGRRKTPEELLRQNQRALNRAMRELDRERQKLETQEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEESDAVVSQVLDELGLSLTDELSNLPSTGGSLSVAAGGKKAEAAASALADADADLEERLKNLRRD

SEQ ID NO: 14485 - protein, 222 aa, Homo sapiens; identical to SEQ ID NO: 14484
  Payload ID: 2816
  Gene Symbol: CHMP2A
  Gene Name: charged multivesicular body protein 2A
  Uniprot ID: O43633
  ENSP ID: ENSP00000469240

SEQ ID NO: 14486 - protein, 55 aa, Homo sapiens
  Payload ID: 2816
  Gene Symbol: CHMP2A
  Gene Name: charged multivesicular body protein 2A
  ENSP ID: ENSP00000469453
MDLLFGRRKTPEELLRQNQRALNRAMRELDRERQKLETQEKKIIADIKKMAKQGQ

SEQ ID NO: 14487 - protein, 159 aa, Homo sapiens
  Payload ID: 2816
  Gene Symbol: CHMP2A
  Gene Name: charged multivesicular body protein 2A
  ENSP ID: ENSP00000471961
MDLLFGRRKTPEELLRQNQRALNRAMRELDRERQKLETQEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEE

SEQ ID NO: 14488 - protein, 227 aa, Homo sapiens
  Payload ID: 2816
  Gene Symbol: CHMP2A
  Gene Name: charged multivesicular body protein 2A
  ENSP ID: ENSP00000472097
  MOD_RES (1)..(1): Any amino acid
XEKKIIADIKKMAKQGQMDAVRIMAKDLVRTRRYVRKFVLMRANIQAVSLKIQTLKSNNSMAQAMKGVTKAMGTMNRQLKLPQIQKIMMEFERQAEIMDMKEEMMNDAIDDAMGDEEDEEESDAVVSQVLDELGLSLTDELSSECSKSWTPFPTQGPATAPSPPFPCITPLRCLTPPAQTPTFSADLPSTGGSLSVAAGGKKAEAAASALADADADLEERLKNLRRD

SEQ ID NO: 14489 - protein, 222 aa, Homo sapiens; identical to SEQ ID NO: 14484
  Payload ID: 2816
  Gene Symbol: CHMP2A
  Gene Name: charged multivesicular body protein 2A
  Uniprot ID: O43633
  ENSP ID: ENSP00000472680

SEQ ID NO: 14490 - protein, 213 aa, Homo sapiens
  Payload ID: 2817
  Gene Symbol: CHMP2B
  Gene Name: charged multivesicular body protein 2B
  Uniprot ID: Q9UQN3
  ENSP ID: ENSP00000263780
MASLFKKKTVDDVIKEQNRELRGTQRAIIRDRAALEKQEKQLELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 14491 - protein, 183 aa, Homo sapiens
  Payload ID: 2817
  Gene Symbol: CHMP2B
  Gene Name: charged multivesicular body protein 2B
  ENSP ID: ENSP00000418920
MASLFKKKTVDDVIKEQNRELRGTQRAIIRDRAALEKQEKQLELEIKKMAKIGNKEACKVLAKQLVHLRKQKTRTFATMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 14492 - protein, 172 aa, Homo sapiens
  Payload ID: 2817
  Gene Symbol: CHMP2B
  Gene Name: charged multivesicular body protein 2B
  Uniprot ID: Q9UQN3
  ENSP ID: ENSP00000419998
MELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIVNQVLDEIGIEISGKMAKAPSAARSLPSASTSKATISDEEIERQLKALGVD

SEQ ID NO: 14493 - protein, 179 aa, Homo sapiens
  Payload ID: 2817
  Gene Symbol: CHMP2B
  Gene Name: charged multivesicular body protein 2B
  ENSP ID: ENSP00000480032
MISAQRNHHLPDSSDSSTSAYRVARITDVIKEQNRELRGTQRAIIRDRAALEKQEKQLELEIKKMAKIGNKEACKVLAKQLVHLRKQKTRTFAVSSKVTSMSTQTKVMNSQMKMAGAMSTTAKTMQAVNKKMDPQKTLQTMQNFQKENMKMEMTEEMINDTLDDIFDGSDDEEESQDIV

SEQ ID NO: 14494 - protein, 222 aa, Homo sapiens
  Payload ID: 2818
  Gene Symbol: CHMP3
  Gene Name: charged multivesicular body protein 3
  Uniprot ID: Q9Y3E7
  ENSP ID: ENSP00000263856
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 14495 - protein, 156 aa, Homo sapiens
  Payload ID: 2818
  Gene Symbol: CHMP3
  Gene Name: charged multivesicular body protein 3
  Uniprot ID: Q9Y3E7
  ENSP ID: ENSP00000386590
MIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 14496 - protein, 182 aa, Homo sapiens
  Payload ID: 2818
  Gene Symbol: CHMP3
  Gene Name: charged multivesicular body protein 3
  Uniprot ID: Q9Y3E7
  ENSP ID: ENSP00000387045
MGLFGKTQEKPPKELVNEWSLKIRKEMRVVDRQIRDIQREEEKVKRSVKDAAKKGQKDVCIVLAKEMIRSRKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 14497 - protein, 265 aa, Homo sapiens
  Payload ID: 2819
  Gene Symbol: CHMP4A
  Gene Name: charged multivesicular body protein 4A
  Uniprot ID: Q9BY43
  ENSP ID: ENSP00000324205
MSRRRPEDGLGKAGPCVMRHHPPRSKAEVWRTLRGGGGRGELAMSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 14498 - protein, 213 aa, Homo sapiens
  Payload ID: 2819
  Gene Symbol: CHMP4A
  Gene Name: charged multivesicular body protein 4A
  ENSP ID: ENSP00000432575
MHSSLGDRGRLHSQKKKKKLGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGP

SEQ ID NO: 14499 - protein, 166 aa, Homo sapiens
  Payload ID: 2819
  Gene Symbol: CHMP4A
  Gene Name: charged multivesicular body protein 4A
  ENSP ID: ENSP00000436224
MSRRRPEDGLGKAGPCVMRHHPPRSKAEVWRTLRGGGGRGELAMSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMWGH

SEQ ID NO: 14500 - protein, 61 aa, Homo sapiens
  Payload ID: 2819
  Gene Symbol: CHMP4A
  Gene Name: charged multivesicular body protein 4A
  ENSP ID: ENSP00000448869
  MOD_RES (1)..(1): Any amino acid
XLGRLFGKGKKEKGPTPEEAIQKLKETEKILIKKQEFLEQKIQQELQTAKKYGTKNKRVSA

SEQ ID NO: 14501 - protein, 117 aa, Homo sapiens
  Payload ID: 2819
  Gene Symbol: CHMP4A
  Gene Name: charged multivesicular body protein 4A
  ENSP ID: ENSP00000449757
MELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 14502 - protein, 222 aa, Homo sapiens
  Payload ID: 2819
  Gene Symbol: CHMP4A
  Gene Name: charged multivesicular body protein 4A
  Uniprot ID: Q9BY43
  ENSP ID: ENSP00000476412
MSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDITEQQEVAQQISDAISRPMGFGDDVDEDELLEELEELEQEELAQELLNVGDKEEEPSVKLPSVPSTHLPAGPAPKVDEDEEALKQLAEWVS

SEQ ID NO: 14503 - protein, 224 aa, Homo sapiens
  Payload ID: 2820
  Gene Symbol: CHMP4B
  Gene Name: charged multivesicular body protein 4B
  Uniprot ID: Q9H444
  ENSP ID: ENSP00000217402
MSVFGKLFGAGGGKAGKGGPTPQEAIQRLRDTEEMLSKKQEFLEKKIEQELTAAKKHGTKNKRAALQALKRKKRYEKQLAQIDGTLSTIEFQREALENANTNTEVLKNMGYAAKAMKAAHDNMDIDKVDELMQDIADQQELAEEISTAISKPVGFGEEFDEDELMAELEELEQEELDKNLLEISGPETVPLPNVPSIALPSKPAKKKEEEDDDMKELENWAGSM

SEQ ID NO: 14504 - protein, 233 aa, Homo sapiens
  Payload ID: 2821
  Gene Symbol: CHMP4C
  Gene Name: charged multivesicular body protein 4C
  Uniprot ID: Q96CF2
  ENSP ID: ENSP00000297265
MSKLGKFFKGGGSSKSRAAPSPQEALVRLRETEEMLGKKQEYLENRIQREIALAKKHGTQNKRAALQALKRKKRFEKQLTQIDGTLSTIEFQREALENSHTNTEVLRNMGFAAKAMKSVHENMDLNKIDDLMQEITEQQDIAQEISEAFSQRVGFGDDFDEDELMAELEELEQEELNKKMTNIRLPNVPSSSLPAQPNRKPGMSSTARRSRAASSQRAEEEDDDIKQLAAWAT

SEQ ID NO: 14505 - protein, 219 aa, Homo sapiens
  Payload ID: 2822
  Gene Symbol: CHMP5
  Gene Name: charged multivesicular body protein 5
  Uniprot ID: Q9NZZ3
  ENSP ID: ENSP00000223500
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 14506 - protein, 171 aa, Homo sapiens
  Payload ID: 2822
  Gene Symbol: CHMP5
  Gene Name: charged multivesicular body protein 5
  Uniprot ID: Q9NZZ3
  ENSP ID: ENSP00000442725
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAGWSSGG

SEQ ID NO: 14507 - protein, 201 aa, Homo sapiens
  Payload ID: 2823
  Gene Symbol: CHMP6
  Gene Name: charged multivesicular body protein 6
  Uniprot ID: Q96FZ7
  ENSP ID: ENSP00000317468
MGNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPENVPVKARPRQAELVAAS

SEQ ID NO: 14508 - protein, 113 aa, Homo sapiens
  Payload ID: 2823
  Gene Symbol: CHMP6
  Gene Name: charged multivesicular body protein 6
  ENSP ID: ENSP00000460389
MVQSIEFTQIEMKVMEGLQFGNECLNKMHQVMSIEEVERILDETQEAVEYQRQIDELLAGSFTQEDEDAILEELSAITQEQIELPEVPSEPLPEKIPENVPVKARPRQAELVA

SEQ ID NO: 14509 - protein, 224 aa, Homo sapiens
  Payload ID: 2823
  Gene Symbol: CHMP6
  Gene Name: charged multivesicular body protein 6
  ENSP ID: ENSP00000461098
QLKQQRDKLRQYQKRIAQQLERERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPGISMFDSFEWLEFAGEKWILEGNKTECSQAFLGRGQALLPGCLAWGRACLALGLGLGFPGVR

SEQ ID NO: 14510 - protein, 173 aa, Homo sapiens
  Payload ID: 2823
  Gene Symbol: CHMP6
  Gene Name: charged multivesicular body protein 6
  ENSP ID: ENSP00000461238
RERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPALPQDGPQLRNCTETRKAKTPIETLSFWQEKL

SEQ ID NO: 14511 - protein, 453 aa, Homo sapiens
  Payload ID: 2824
  Gene Symbol: CHMP7
  Gene Name: charged multivesicular body protein 7
  Uniprot ID: Q8WUX9
  ENSP ID: ENSP00000324491
MWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 14512 - protein, 453 aa, Homo sapiens; identical to SEQ ID NO: 14511
  Payload ID: 2824
  Gene Symbol: CHMP7
  Gene Name: charged multivesicular body protein 7
  Uniprot ID: Q8WUX9
  ENSP ID: ENSP00000380794

SEQ ID NO: 14513 - protein, 163 aa, Homo sapiens
  Payload ID: 2824
  Gene Symbol: CHMP7
  Gene Name: charged multivesicular body protein 7
  Uniprot ID: Q8WUX9
  ENSP ID: ENSP00000427948
MWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRKRLRRCIVCIRTRPSPPTPWWPCQSSAPSVLTPAQMRGPSTWCCCSCRRRRGSQSSSRTGRRL

SEQ ID NO: 14514 - protein, 157 aa, Homo sapiens
  Payload ID: 2824
  Gene Symbol: CHMP7
  Gene Name: charged multivesicular body protein 7
  ENSP ID: ENSP00000428233
MWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRRGELQRESDFMASVDSSWISWGVGVFLLKPLKWTLSNMLGDNKVPAEEVLVAVELLK

SEQ ID NO: 14515 - protein, 79 aa, Homo sapiens
  Payload ID: 2824
  Gene Symbol: CHMP7
  Gene Name: charged multivesicular body protein 7
  ENSP ID: ENSP00000430321
MWSPEREAEAPAGGDPAGLLPPEWEEDEERMSFLFSAFKRSRESRGAAAGVRLHGQCRQQLDLLGGWGLPAEASQVDSF

SEQ ID NO: 14516 - protein, 209 aa, Homo sapiens
  Payload ID: 2824
  Gene Symbol: CHMP7
  Gene Name: charged multivesicular body protein 7
  ENSP ID: ENSP00000430661
MWSPEREAEAPAGGDPAGLLPPEWEEDEERMSFLFSAFKRSREVNSTDWDSKMGFWAPLVLSHSRRQGVVRLRLRDLQEAFQRKGSVPLGLATVLQDLLRTFPLDWTLILPRMVSNSCTQAILPPQPPKVLRLQALSHCTWPTRLSEMAYSGNRFRSCLKQGTGETVVEEEKAEEVYRLYQNSPLSSHPVVALSELSTLCANSCPDERT

SEQ ID NO: 14517 - protein, 432 aa, Homo sapiens
  Payload ID: 2825
  Gene Symbol: CHEK1
  Gene Name: checkpoint kinase 1
  ENSP ID: ENSP00000278916
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQVTISTTDRRNNKLIFKVNLLEMDDKILVDFRLSKGDGLEFKRHFLKIKGKLIDIVSSQKIWLPAT

SEQ ID NO: 14518 - protein, 476 aa, Homo sapiens
  Payload ID: 2825
  Gene Symbol: CHEK1
  Gene Name: checkpoint kinase 1
  Uniprot ID: O14757
  ENSP ID: ENSP00000388648
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 14519 - protein, 492 aa, Homo sapiens
  Payload ID: 2825
  Gene Symbol: CHEK1
  Gene Name: checkpoint kinase 1
  ENSP ID: ENSP00000391090
MRSAVLKSLQPGSLPDCKAALGGSGNISTSPFWSRRHSEGQDTGTRAVLLYGAGARVCGSVTPSSFGGKSAAFGFLQWWAKDSPPRCSVESWQCPLWKTGTWCKPWEKVPMEKPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 14520 - protein, 476 aa, Homo sapiens; identical to SEQ ID NO: 14518
  Payload ID: 2825
  Gene Symbol: CHEK1
  Gene Name: checkpoint kinase 1
  Uniprot ID: O14757
  ENSP ID: ENSP00000412504

SEQ ID NO: 14521 - protein, 204 aa, Homo sapiens
  Payload ID: 2825
  Gene Symbol: CHEK1
  Gene Name: checkpoint kinase 1
  ENSP ID: ENSP00000431525
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAG

SEQ ID NO: 14522 - protein, 170 aa, Homo sapiens
  Payload ID: 2825
  Gene Symbol: CHEK1
  Gene Name: checkpoint kinase 1
  ENSP ID: ENSP00000431815
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGT

SEQ ID NO: 14523 - protein, 127 aa, Homo sapiens
  Payload ID: 2825
  Gene Symbol: CHEK1
  Gene Name: checkpoint kinase 1
  ENSP ID: ENSP00000432470
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGIT

SEQ ID NO: 14524 - protein, 476 aa, Homo sapiens; identical to SEQ ID NO: 14518
  Payload ID: 2825
  Gene Symbol: CHEK1
  Gene Name: checkpoint kinase 1
  Uniprot ID: O14757
  ENSP ID: ENSP00000432890

SEQ ID NO: 14525 - protein, 42 aa, Homo sapiens
  Payload ID: 2825
  Gene Symbol: CHEK1
  Gene Name: checkpoint kinase 1
  ENSP ID: ENSP00000433103
MAVPFVEDWDLVQTLGEGAYGEVQLAVNRVTEEAVAVKIVDM

SEQ ID NO: 14526 - protein, 117 aa, Homo sapiens
  Payload ID: 2825
  Gene Symbol: CHEK1
  Gene Name: checkpoint kinase 1
  ENSP ID: ENSP00000434141
MRSAVLKSLQPGSLPDCKAALGGSGNISTSPFWSRRHSEGQDTGTRAVLLYGAGARVCGSVTPSSFGGKSAAFGFLQWWAKDSPPRCSVESWQCPLWKTGTWCKPWEKVPMEKFNLL

SEQ ID NO: 14527 - protein, 192 aa, Homo sapiens
  Payload ID: 2825
  Gene Symbol: CHEK1
  Gene Name: checkpoint kinase 1
  ENSP ID: ENSP00000434646
MAVPFVEDWDLVQTLGEEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKK

SEQ ID NO: 14528 - protein, 476 aa, Homo sapiens; identical to SEQ ID NO: 14518
  Payload ID: 2825
  Gene Symbol: CHEK1
  Gene Name: checkpoint kinase 1
  Uniprot ID: O14757
  ENSP ID: ENSP00000435371

SEQ ID NO: 14529 - protein, 382 aa, Homo sapiens
  Payload ID: 2825
  Gene Symbol: CHEK1
  Gene Name: checkpoint kinase 1
  Uniprot ID: O14757
  ENSP ID: ENSP00000442317
MEKPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 14530 - protein, 110 aa, Homo sapiens
  Payload ID: 2825
  Gene Symbol: CHEK1
  Gene Name: checkpoint kinase 1
  ENSP ID: ENSP00000477588
MKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGL

SEQ ID NO: 14531 - protein, 89 aa, Homo sapiens
  Payload ID: 2825
  Gene Symbol: CHEK1
  Gene Name: checkpoint kinase 1
  ENSP ID: ENSP00000481614
KSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 14532 - protein, 442 aa, Homo sapiens
  Payload ID: 2825
  Gene Symbol: CHEK1
  Gene Name: checkpoint kinase 1
  Uniprot ID: O14757
  ENSP ID: ENSP00000481616
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQGDGLEFKRHFLKIKGKLIDIVSSQKIWLPAT

SEQ ID NO: 14533 - protein, 514 aa, Homo sapiens
  Payload ID: 2826
  Gene Symbol: CHEK2
  Gene Name: checkpoint kinase 2
  Uniprot ID: O96017
  ENSP ID: ENSP00000329012
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 14534 - protein, 543 aa, Homo sapiens
  Payload ID: 2826
  Gene Symbol: CHEK2
  Gene Name: checkpoint kinase 2
  Uniprot ID: O96017
  ENSP ID: ENSP00000329178
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 14535 - protein, 207 aa, Homo sapiens
  Payload ID: 2826
  Gene Symbol: CHEK2
  Gene Name: checkpoint kinase 2
  ENSP ID: ENSP00000372006
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKEKILKIYSLS

SEQ ID NO: 14536 - protein, 586 aa, Homo sapiens
  Payload ID: 2826
  Gene Symbol: CHEK2
  Gene Name: checkpoint kinase 2
  Uniprot ID: O96017
  ENSP ID: ENSP00000372023
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 14537 - protein, 172 aa, Homo sapiens
  Payload ID: 2826
  Gene Symbol: CHEK2
  Gene Name: checkpoint kinase 2
  ENSP ID: ENSP00000381099
MLRLLTSMVVMSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIED

SEQ ID NO: 14538 - protein, 514 aa, Homo sapiens; identical to SEQ ID NO: 14533
  Payload ID: 2826
  Gene Symbol: CHEK2
  Gene Name: checkpoint kinase 2
  Uniprot ID: O96017
  ENSP ID: ENSP00000384835

SEQ ID NO: 14539 - protein, 452 aa, Homo sapiens
  Payload ID: 2826
  Gene Symbol: CHEK2
  Gene Name: checkpoint kinase 2
  Uniprot ID: O96017
  ENSP ID: ENSP00000384919
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 14540 - protein, 543 aa, Homo sapiens; identical to SEQ ID NO: 14534
  Payload ID: 2826
  Gene Symbol: CHEK2
  Gene Name: checkpoint kinase 2
  Uniprot ID: O96017
  ENSP ID: ENSP00000385747

SEQ ID NO: 14541 - protein, 543 aa, Homo sapiens; identical to SEQ ID NO: 14534
  Payload ID: 2826
  Gene Symbol: CHEK2
  Gene Name: checkpoint kinase 2
  Uniprot ID: O96017
  ENSP ID: ENSP00000386087

SEQ ID NO: 14542 - protein, 45 aa, Homo sapiens
  Payload ID: 2826
  Gene Symbol: CHEK2
  Gene Name: checkpoint kinase 2
  ENSP ID: ENSP00000387451
SSDPPASASQSAGIRGVRHHPRPVCSLIETGFHRVSQDGLHLLTS

SEQ ID NO: 14543 - protein, 121 aa, Homo sapiens
  Payload ID: 2826
  Gene Symbol: CHEK2
  Gene Name: checkpoint kinase 2
  ENSP ID: ENSP00000390244
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENG

SEQ ID NO: 14544 - protein, 144 aa, Homo sapiens
  Payload ID: 2826
  Gene Symbol: CHEK2
  Gene Name: checkpoint kinase 2
  ENSP ID: ENSP00000394430
  MOD_RES (1)..(1): Any amino acid
XIISKRKFAIGSAREADPALNVETEIEILKKLNHPCIIKIKNFFDAEDYYIVLELMEGGELFDKVVGNKRLKEATCKLYFYQMLLAVQDEDMKRKFQDLLSEENESTALPQVLAQPSTSRKRPREGEAEGAETTKRPAVCAAVL

SEQ ID NO: 14545 - protein, 57 aa, Homo sapiens
  Payload ID: 2826
  Gene Symbol: CHEK2
  Gene Name: checkpoint kinase 2
  ENSP ID: ENSP00000396903
FREVGPKNSYIAYIEDHSGNGTFVNTELVGKGKRRPLNNNSEIALSLSRNKVVPVER

SEQ ID NO: 14546 - protein, 298 aa, Homo sapiens
  Payload ID: 2826
  Gene Symbol: CHEK2
  Gene Name: checkpoint kinase 2
  ENSP ID: ENSP00000397478
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREENLSCPYRIWFNGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIK

SEQ ID NO: 14547 - protein, 207 aa, Homo sapiens; identical to SEQ ID NO: 14535
  Payload ID: 2826
  Gene Symbol: CHEK2
  Gene Name: checkpoint kinase 2
  ENSP ID: ENSP00000402225

SEQ ID NO: 14548 - protein, 161 aa, Homo sapiens
  Payload ID: 2826
  Gene Symbol: CHEK2
  Gene Name: checkpoint kinase 2
  ENSP ID: ENSP00000403659
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREENLSCPYRIWFK

SEQ ID NO: 14549 - protein, 289 aa, Homo sapiens
  Payload ID: 2826
  Gene Symbol: CHEK2
  Gene Name: checkpoint kinase 2
  Uniprot ID: O96017
  ENSP ID: ENSP00000404400
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHDGRGRAV

SEQ ID NO: 14550 - protein, 165 aa, Homo sapiens
  Payload ID: 2826
  Gene Symbol: CHEK2
  Gene Name: checkpoint kinase 2
  Uniprot ID: O96017
  ENSP ID: ENSP00000404567
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREENLSCPYRIWFNFCLF

SEQ ID NO: 14551 - protein, 295 aa, Homo sapiens
  Payload ID: 2826
  Gene Symbol: CHEK2
  Gene Name: checkpoint kinase 2
  ENSP ID: ENSP00000408065
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREA

SEQ ID NO: 14552 - protein, 203 aa, Homo sapiens
  Payload ID: 2826
  Gene Symbol: CHEK2
  Gene Name: checkpoint kinase 2
  Uniprot ID: O96017
  ENSP ID: ENSP00000412901
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVVPVER

SEQ ID NO: 14553 - protein, 276 aa, Homo sapiens
  Payload ID: 2826
  Gene Symbol: CHEK2
  Gene Name: checkpoint kinase 2
  ENSP ID: ENSP00000416721
  MOD_RES (1)..(1): Any amino acid
XIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFIWTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 14554 - protein, 137 aa, Homo sapiens
  Payload ID: 2826
  Gene Symbol: CHEK2
  Gene Name: checkpoint kinase 2
  ENSP ID: ENSP00000483777
MERLLYGIGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSS

SEQ ID NO: 14555 - protein, 623 aa, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENSP ID: ENSP00000266880
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEMVPCCVAQAGLKLLGSSDPPTLASQSIVITGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 14556 - protein, 349 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000320557
MTQESFGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCVSGRQCFPATSL

SEQ ID NO: 14557 - protein, 664 aa, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENSP ID: ENSP00000392395
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEANKENVFHGTKDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 14558 - protein, 652 aa, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENSP ID: ENSP00000398735
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 14559 - protein, 572 aa, Homo sapiens
  Payload ID: 2827
  Gene Symbol: CHFR
  Gene Name: checkpoint with forkhead and ring finger domains, E3 ubiquitin protein ligase
  Uniprot ID: Q96EP1
  ENSP ID: ENSP00000416431
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHRSGGGGISPKGSGPSVASDEVSSFASALPDRKTASFSSLEPQDQEDLEPVKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPSTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 14560 - protein, 223 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000441837
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFDTSGAGAGRGADPRVPPSSPATQVCFEEPQPSTSTSDLFPTASASSTEPSPAGRERSSSCGSGGGGISPKGSGPSVASDEVSSFASALP

SEQ ID NO: 14561 - protein, 25 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000443237
MTQESFASASSTEPSPAGRERSSSC

SEQ ID NO: 14562 - protein, 71 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000443761
MTQESFEANKENVFHGTKDTSGAGAGRGADPRVPPSSPATQVCFEEPQPSTSTSDLFPTASASSTEPSPAG

SEQ ID NO: 14563 - protein, 136 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000445371
MTQESFDTSGAGAGRGADPRVPPSSPATQVCFEEPQPSTSTSDLFPTASASSTEPSPAGRERSSSCGSGGGGISPKGSGPSVASDEVSSFASALPDRKTASFSSLEPQDQEDLEPVKKKMRGDGDLDLNGQLLVAQ

SEQ ID NO: 14564 - protein, 31 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000475247
MTQESFDTSGAGAGRGADPRVPPSSPATQVC

SEQ ID NO: 14565 - protein, 60 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000478791
LQPKVRRSFSDEEGSSEDLLELSDVDSESSDIRCGLPAAFLPPVLGLHPDRLLRLPGPVL

SEQ ID NO: 14566 - protein, 75 aa, Homo sapiens
  Payload ID: 2827
  Gene Symbol: CHFR
  Gene Name: checkpoint with forkhead and ring finger domains, E3 ubiquitin protein ligase
  ENSP ID: ENSP00000483699
  MOD_RES (1)..(1): Any amino acid
XAEREQDPRVAPQQCAVCLQPFCHLYWGCTRTGCYGCLAPFCESVMKRNMFILSVGQTVLSCDIIINRITWQPEV

SEQ ID NO: 14567 - protein, 373 aa, Homo sapiens
  Payload ID: 2828
  Gene Symbol: CMKLR1
  Gene Name: chemerin chemokine-like receptor 1
  Uniprot ID: Q99788
  ENSP ID: ENSP00000311733
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 14568 - protein, 373 aa, Homo sapiens; identical to SEQ ID NO: 14567
  Payload ID: 2828
  Gene Symbol: CMKLR1
  Gene Name: chemerin chemokine-like receptor 1
  Uniprot ID: Q99788
  ENSP ID: ENSP00000401293

SEQ ID NO: 14569 - protein, 371 aa, Homo sapiens
  Payload ID: 2828
  Gene Symbol: CMKLR1
  Gene Name: chemerin chemokine-like receptor 1
  Uniprot ID: Q99788
  ENSP ID: ENSP00000447579
MEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 14570 - protein, 143 aa, Homo sapiens
  Payload ID: 2828
  Gene Symbol: CMKLR1
  Gene Name: chemerin chemokine-like receptor 1
  ENSP ID: ENSP00000448362
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLL

SEQ ID NO: 14571 - protein, 147 aa, Homo sapiens
  Payload ID: 2828
  Gene Symbol: CMKLR1
  Gene Name: chemerin chemokine-like receptor 1
  ENSP ID: ENSP00000448925
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWS

SEQ ID NO: 14572 - protein, 373 aa, Homo sapiens; identical to SEQ ID NO: 14567
  Payload ID: 2828
  Gene Symbol: CMKLR1
  Gene Name: chemerin chemokine-like receptor 1
  Uniprot ID: Q99788
  ENSP ID: ENSP00000449716

SEQ ID NO: 14573 - protein, 114 aa, Homo sapiens
  Payload ID: 2829
  Gene Symbol: XCL1
  Gene Name: chemokine (C motif) ligand 1
  Uniprot ID: P47992
  ENSP ID: ENSP00000356792
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 14574 - protein, 114 aa, Homo sapiens
  Payload ID: 2830
  Gene Symbol: XCL2
  Gene Name: chemokine (C motif) ligand 2
  Uniprot ID: Q9UBD3
  ENSP ID: ENSP00000356793
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 14575 - protein, 333 aa, Homo sapiens
  Payload ID: 2831
  Gene Symbol: XCR1
  Gene Name: chemokine (C motif) receptor 1
  Uniprot ID: P46094
  ENSP ID: ENSP00000310405
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 14576 - protein, 36 aa, Homo sapiens
  Payload ID: 2831
  Gene Symbol: XCR1
  Gene Name: chemokine (C motif) receptor 1
  ENSP ID: ENSP00000379277
MESSGNPESTTFFYYDLQSQPCENQAWVFATLATTV

SEQ ID NO: 14577 - protein, 96 aa, Homo sapiens
  Payload ID: 2832
  Gene Symbol: CCL1
  Gene Name: chemokine (C-C motif) ligand 1
  Uniprot ID: P22362
  ENSP ID: ENSP00000225842
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 14578 - protein, 97 aa, Homo sapiens
  Payload ID: 2833
  Gene Symbol: CCL11
  Gene Name: chemokine (C-C motif) ligand 11
  Uniprot ID: P51671
  ENSP ID: ENSP00000302234
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 14579 - protein, 98 aa, Homo sapiens
  Payload ID: 2834
  Gene Symbol: CCL13
  Gene Name: chemokine (C-C motif) ligand 13
  Uniprot ID: Q99616
  ENSP ID: ENSP00000225844
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 14580 - protein, 63 aa, Homo sapiens
  Payload ID: 2834
  Gene Symbol: CCL13
  Gene Name: chemokine (C-C motif) ligand 13
  ENSP ID: ENSP00000463667
  MOD_RES (1)..(1): Any amino acid
XVPSTCCFTFSSKKISLQRLKSYVITTSSFRTKLGKEICADPKEKWVQNYMKHLGRKAHTLKT

SEQ ID NO: 14581 - protein, 109 aa, Homo sapiens
  Payload ID: 2835
  Gene Symbol: CCL14
  Gene Name: chemokine (C-C motif) ligand 14
  Uniprot ID: Q16627
  ENSP ID: ENSP00000479097
MKISVAAIPFFLLITIALGTKTESSSQTGGKPKVVKIQLKLVGGPYHPSECCFTYTTYKIPRQRIMDYYETNSQCSKPGIVFITKRGHSVCTNPSDKWVQDYIKDMKEN

SEQ ID NO: 14582 - protein, 93 aa, Homo sapiens
  Payload ID: 2835
  Gene Symbol: CCL14
  Gene Name: chemokine (C-C motif) ligand 14
  Uniprot ID: Q16627
  ENSP ID: ENSP00000481023
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 14583 - protein, 65 aa, Homo sapiens
  Payload ID: 2835
  Gene Symbol: CCL14
  Gene Name: chemokine (C-C motif) ligand 14
  ENSP ID: ENSP00000482426
MKISVAAIPFFLLITIALGTKTESSSRGPYHPSECCFTYTTYKIPRQRIMDYYETNSQCSKPGIV

SEQ ID NO: 14584 - protein, 115 aa, Homo sapiens
  Payload ID: 2835
  Gene Symbol: CCL14
  Gene Name: chemokine (C-C motif) ligand 14
  ENSP ID: ENSP00000483186
MRKAYSPLQVLRGCLLLPSLLHALSLQEQPMVWPLTRGPSSASDALSSGGPYHPSECCFTYTTYKIPRQRIMDYYETNSQCSKPGIVFITKRGHSVCTNPSDKWVQDYIKDMKEN

SEQ ID NO: 14585 - protein, 109 aa, Homo sapiens; identical to SEQ ID NO: 14581
  Payload ID: 2835
  Gene Symbol: CCL14
  Gene Name: chemokine (C-C motif) ligand 14
  Uniprot ID: Q16627
  ENSP ID: ENSP00000483302

SEQ ID NO: 14586 - protein, 65 aa, Homo sapiens; identical to SEQ ID NO: 14583
  Payload ID: 2835
  Gene Symbol: CCL14
  Gene Name: chemokine (C-C motif) ligand 14
  ENSP ID: ENSP00000484818

SEQ ID NO: 14587 - protein, 93 aa, Homo sapiens; identical to SEQ ID NO: 14582
  Payload ID: 2835
  Gene Symbol: CCL14
  Gene Name: chemokine (C-C motif) ligand 14
  Uniprot ID: Q16627
  ENSP ID: ENSP00000487948

SEQ ID NO: 14588 - protein, 115 aa, Homo sapiens; identical to SEQ ID NO: 14584
  Payload ID: 2835
  Gene Symbol: CCL14
  Gene Name: chemokine (C-C motif) ligand 14
  ENSP ID: ENSP00000488545

SEQ ID NO: 14589 - protein, 113 aa, Homo sapiens; identical to SEQ ID NO: 12738
  Payload ID: 2836
  Gene Symbol: CCL15
  Gene Name: chemokine (C-C motif) ligand 15
  Uniprot ID: Q16663
  ENSP ID: ENSP00000477788

SEQ ID NO: 14590 - protein, 113 aa, Homo sapiens; identical to SEQ ID NO: 12736
  Payload ID: 2836
  Gene Symbol: CCL15
  Gene Name: chemokine (C-C motif) ligand 15
  Uniprot ID: Q16663
  ENSP ID: ENSP00000484078

SEQ ID NO: 14591 - protein, 61 aa, Homo sapiens
  Payload ID: 2836
  Gene Symbol: CCL15
  Gene Name: chemokine (C-C motif) ligand 15
  ENSP ID: ENSP00000484262
  MOD_RES (1)..(1): Any amino acid
XCTSYISQSIPCSLMKSYFETSSECSKPGVIFLTKKGRQVCAKPSGPGVQDCMKKLKPYSI

SEQ ID NO: 14592 - protein, 61 aa, Homo sapiens; identical to SEQ ID NO: 14591
  Payload ID: 2836
  Gene Symbol: CCL15
  Gene Name: chemokine (C-C motif) ligand 15
  ENSP ID: ENSP00000488746
  MOD_RES (1)..(1): Any amino acid

SEQ ID NO: 14593 - protein, 120 aa, Homo sapiens
  Payload ID: 2837
  Gene Symbol: CCL16
  Gene Name: chemokine (C-C motif) ligand 16
  Uniprot ID: O15467
  ENSP ID: ENSP00000478024
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 14594 - protein, 95 aa, Homo sapiens
  Payload ID: 2837
  Gene Symbol: CCL16
  Gene Name: chemokine (C-C motif) ligand 16
  ENSP ID: ENSP00000478592
  MOD_RES (1)..(1): Any amino acid
XVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 14595 - protein, 53 aa, Homo sapiens
  Payload ID: 2837
  Gene Symbol: CCL16
  Gene Name: chemokine (C-C motif) ligand 16
  ENSP ID: ENSP00000478934
MKVSEAALSLLVLILIITSASRSQPSWSAVSRSRLTTTSASRVQVILLPQPPE

SEQ ID NO: 14596 - protein, 120 aa, Homo sapiens; identical to SEQ ID NO: 14593
  Payload ID: 2837
  Gene Symbol: CCL16
  Gene Name: chemokine (C-C motif) ligand 16
  Uniprot ID: O15467
  ENSP ID: ENSP00000482168

SEQ ID NO: 14597 - protein, 53 aa, Homo sapiens; identical to SEQ ID NO: 14595
  Payload ID: 2837
  Gene Symbol: CCL16
  Gene Name: chemokine (C-C motif) ligand 16
  ENSP ID: ENSP00000487933

SEQ ID NO: 14598 - protein, 95 aa, Homo sapiens; identical to SEQ ID NO: 14594
  Payload ID: 2837
  Gene Symbol: CCL16
  Gene Name: chemokine (C-C motif) ligand 16
  ENSP ID: ENSP00000488847
  MOD_RES (1)..(1): Any amino acid

SEQ ID NO: 14599 - protein, 94 aa, Homo sapiens
  Payload ID: 2838
  Gene Symbol: CCL17
  Gene Name: chemokine (C-C motif) ligand 17
  Uniprot ID: Q92583
  ENSP ID: ENSP00000219244
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 14600 - protein, 94 aa, Homo sapiens; identical to SEQ ID NO: 14599
  Payload ID: 2838
  Gene Symbol: CCL17
  Gene Name: chemokine (C-C motif) ligand 17
  Uniprot ID: Q92583
  ENSP ID: ENSP00000480147

SEQ ID NO: 14601 - protein, 89 aa, Homo sapiens
  Payload ID: 2839
  Gene Symbol: CCL18
  Gene Name: chemokine (C-C motif) ligand 18 (pulmonary and activation-regulated)
  Uniprot ID: P55774
  ENSP ID: ENSP00000479955
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 14602 - protein, 89 aa, Homo sapiens; identical to SEQ ID NO: 14601
  Payload ID: 2839
  Gene Symbol: CCL18
  Gene Name: chemokine (C-C motif) ligand 18 (pulmonary and activation-regulated)
  Uniprot ID: P55774
  ENSP ID: ENSP00000483144

SEQ ID NO: 14603 - protein, 89 aa, Homo sapiens; identical to SEQ ID NO: 14601
  Payload ID: 2839
  Gene Symbol: CCL18
  Gene Name: chemokine (C-C motif) ligand 18 (pulmonary and activation-regulated)
  Uniprot ID: P55774
  ENSP ID: ENSP00000483347

SEQ ID NO: 14604 - protein, 98 aa, Homo sapiens
  Payload ID: 2840
  Gene Symbol: CCL19
  Gene Name: chemokine (C-C motif) ligand 19
  Uniprot ID: Q99731
  ENSP ID: ENSP00000308815
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 14605 - protein, 104 aa, Homo sapiens
  Payload ID: 2840
  Gene Symbol: CCL19
  Gene Name: chemokine (C-C motif) ligand 19
  ENSP ID: ENSP00000368077
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKASLALPGPVSSL

SEQ ID NO: 14606 - protein, 99 aa, Homo sapiens
  Payload ID: 2841
  Gene Symbol: CCL2
  Gene Name: chemokine (C-C motif) ligand 2
  Uniprot ID: P13500
  ENSP ID: ENSP00000225831
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 14607 - protein, 65 aa, Homo sapiens
  Payload ID: 2841
  Gene Symbol: CCL2
  Gene Name: chemokine (C-C motif) ligand 2
  ENSP ID: ENSP00000462156
MKVSAALLCLLLIAATFIPQGLAQPDAINAPVTCCYNFTNRKISVQRLASYRRITSSKCPKEAVM

SEQ ID NO: 14608 - protein, 96 aa, Homo sapiens
  Payload ID: 2842
  Gene Symbol: CCL20
  Gene Name: chemokine (C-C motif) ligand 20
  Uniprot ID: P78556
  ENSP ID: ENSP00000351671
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 14609 - protein, 95 aa, Homo sapiens
  Payload ID: 2842
  Gene Symbol: CCL20
  Gene Name: chemokine (C-C motif) ligand 20
  Uniprot ID: P78556
  ENSP ID: ENSP00000386273
MCCTKSLLLAALMSVLLLHLCGESEASNFDCCLGYTDRILHPKFIVGFTRQLANEGCDINAIIFHTKKKLSVCANPKQTWVKYIVRLLSKKVKNM

SEQ ID NO: 14610 - protein, 134 aa, Homo sapiens
  Payload ID: 2843
  Gene Symbol: CCL21
  Gene Name: chemokine (C-C motif) ligand 21
  Uniprot ID: O00585
  ENSP ID: ENSP00000259607
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 14611 - protein, 124 aa, Homo sapiens
  Payload ID: 2843
  Gene Symbol: CCL21
  Gene Name: chemokine (C-C motif) ligand 21
  ENSP ID: ENSP00000368069
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKR

SEQ ID NO: 14612 - protein, 93 aa, Homo sapiens
  Payload ID: 2844
  Gene Symbol: CCL22
  Gene Name: chemokine (C-C motif) ligand 22
  Uniprot ID: O00626
  ENSP ID: ENSP00000219235
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 14613 - protein, 13 aa, Homo sapiens
  Payload ID: 2845
  Gene Symbol: CCL23
  Gene Name: chemokine (C-C motif) ligand 23
  ENSP ID: ENSP00000479076
FETNSECSKPGVM

SEQ ID NO: 14614 - protein, 137 aa, Homo sapiens
  Payload ID: 2845
  Gene Symbol: CCL23
  Gene Name: chemokine (C-C motif) ligand 23
  Uniprot ID: P55773
  ENSP ID: ENSP00000481357
MKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCMRMLKLDTRIKTRKN

SEQ ID NO: 14615 - protein, 137 aa, Homo sapiens
  Payload ID: 2845
  Gene Symbol: CCL23
  Gene Name: chemokine (C-C motif) ligand 23
  Uniprot ID: P55773
  ENSP ID: ENSP00000483546
MKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCVRMLKLDTRIKTRKN

SEQ ID NO: 14616 - protein, 120 aa, Homo sapiens
  Payload ID: 2845
  Gene Symbol: CCL23
  Gene Name: chemokine (C-C motif) ligand 23
  Uniprot ID: P55773
  ENSP ID: ENSP00000484748
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCMRMLKLDTRIKTRKN

SEQ ID NO: 14617 - protein, 120 aa, Homo sapiens
  Payload ID: 2845
  Gene Symbol: CCL23
  Gene Name: chemokine (C-C motif) ligand 23
  Uniprot ID: P55773
  ENSP ID: ENSP00000488270
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCVRMLKLDTRIKTRKN

SEQ ID NO: 14618 - protein, 13 aa, Homo sapiens
  Payload ID: 2845
  Gene Symbol: CCL23
  Gene Name: chemokine (C-C motif) ligand 23
  ENSP ID: ENSP00000488467
FETNSECSKPGVM

SEQ ID NO: 14619 - protein, 119 aa, Homo sapiens
  Payload ID: 2846
  Gene Symbol: CCL24
  Gene Name: chemokine (C-C motif) ligand 24
  Uniprot ID: O00175
  ENSP ID: ENSP00000222902
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 14620 - protein, 119 aa, Homo sapiens; identical to SEQ ID NO: 14619
  Payload ID: 2846
  Gene Symbol: CCL24
  Gene Name: chemokine (C-C motif) ligand 24
  Uniprot ID: O00175
  ENSP ID: ENSP00000400533

SEQ ID NO: 14621 - protein, 149 aa, Homo sapiens
  Payload ID: 2847
  Gene Symbol: CCL25
  Gene Name: chemokine (C-C motif) ligand 25
  Uniprot ID: O15444
  ENSP ID: ENSP00000253451
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQGPHAVKKLSSGNSKLSSSKFSNPISSSKRNVSLLISANSGL

SEQ ID NO: 14622 - protein, 150 aa, Homo sapiens
  Payload ID: 2847
  Gene Symbol: CCL25
  Gene Name: chemokine (C-C motif) ligand 25
  ENSP ID: ENSP00000324756
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGK

SEQ ID NO: 14623 - protein, 150 aa, Homo sapiens
  Payload ID: 2847
  Gene Symbol: CCL25
  Gene Name: chemokine (C-C motif) ligand 25
  Uniprot ID: O15444
  ENSP ID: ENSP00000375086
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 14624 - protein, 84 aa, Homo sapiens
  Payload ID: 2847
  Gene Symbol: CCL25
  Gene Name: chemokine (C-C motif) ligand 25
  ENSP ID: ENSP00000401882
MNLWLLACLVAGFLGAWAPAVHTQGVFEDCCLAYHYPIGWAVLRRAWTYRIQEVSGSCNLPAAIRPSCCKEVEFWKLQVIIVQV

SEQ ID NO: 14625 - protein, 94 aa, Homo sapiens
  Payload ID: 2848
  Gene Symbol: CCL26
  Gene Name: chemokine (C-C motif) ligand 26
  Uniprot ID: Q9Y258
  ENSP ID: ENSP00000005180
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 14626 - protein, 94 aa, Homo sapiens; identical to SEQ ID NO: 14625
  Payload ID: 2848
  Gene Symbol: CCL26
  Gene Name: chemokine (C-C motif) ligand 26
  Uniprot ID: Q9Y258
  ENSP ID: ENSP00000378365

SEQ ID NO: 14627 - protein, 112 aa, Homo sapiens
  Payload ID: 2849
  Gene Symbol: CCL27
  Gene Name: chemokine (C-C motif) ligand 27
  Uniprot ID: Q9Y4X3
  ENSP ID: ENSP00000259631
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 14628 - protein, 127 aa, Homo sapiens
  Payload ID: 2850
  Gene Symbol: CCL28
  Gene Name: chemokine (C-C motif) ligand 28
  Uniprot ID: Q9NRJ3
  ENSP ID: ENSP00000354416
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 14629 - protein, 80 aa, Homo sapiens
  Payload ID: 2850
  Gene Symbol: CCL28
  Gene Name: chemokine (C-C motif) ligand 28
  ENSP ID: ENSP00000422369
MCRIQRADGDCDLAAVILHVKRRRICVSPHNHTVKQWMKVQAAKKNGKGNVCHRKKHHGKRNSNRAHQGKHETYGHKTPY

SEQ ID NO: 14630 - protein, 127 aa, Homo sapiens; identical to SEQ ID NO: 14628
  Payload ID: 2850
  Gene Symbol: CCL28
  Gene Name: chemokine (C-C motif) ligand 28
  Uniprot ID: Q9NRJ3
  ENSP ID: ENSP00000426424

SEQ ID NO: 14631 - protein, 92 aa, Homo sapiens
  Payload ID: 2851
  Gene Symbol: CCL3
  Gene Name: chemokine (C-C motif) ligand 3
  Uniprot ID: P10147
  ENSP ID: ENSP00000477908
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 14632 - protein, 92 aa, Homo sapiens; identical to SEQ ID NO: 14631
  Payload ID: 2851
  Gene Symbol: CCL3
  Gene Name: chemokine (C-C motif) ligand 3
  ENSP ID: ENSP00000480753

SEQ ID NO: 14633 - protein, 92 aa, Homo sapiens; identical to SEQ ID NO: 14631
  Payload ID: 2851
  Gene Symbol: CCL3
  Gene Name: chemokine (C-C motif) ligand 3
  Uniprot ID: P10147
  ENSP ID: ENSP00000483712

SEQ ID NO: 14634 - protein, 93 aa, Homo sapiens
  Payload ID: 2852
  Gene Symbol: CCL3L1
  Gene Name: chemokine (C-C motif) ligand 3-like 1
  Uniprot ID: P16619
  ENSP ID: ENSP00000484704
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 14635 - protein, 93 aa, Homo sapiens; identical to SEQ ID NO: 14634
  Payload ID: 2853
  Gene Symbol: CCL3L3
  Gene Name: chemokine (C-C motif) ligand 3-like 3
  Uniprot ID: P16619
  ENSP ID: ENSP00000480051

SEQ ID NO: 14636 - protein, 93 aa, Homo sapiens; identical to SEQ ID NO: 14634
  Payload ID: 2853
  Gene Symbol: CCL3L3
  Gene Name: chemokine (C-C motif) ligand 3-like 3
  Uniprot ID: P16619
  ENSP ID: ENSP00000480558

SEQ ID NO: 14637 - protein, 93 aa, Homo sapiens; identical to SEQ ID NO: 14634
  Payload ID: 2853
  Gene Symbol: CCL3L3
  Gene Name: chemokine (C-C motif) ligand 3-like 3
  Uniprot ID: P16619
  ENSP ID: ENSP00000482487

SEQ ID NO: 14638 - protein, 92 aa, Homo sapiens
  Payload ID: 2854
  Gene Symbol: CCL4
  Gene Name: chemokine (C-C motif) ligand 4
  ENSP ID: ENSP00000478708
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 14639 - protein, 52 aa, Homo sapiens
  Payload ID: 2854
  Gene Symbol: CCL4
  Gene Name: chemokine (C-C motif) ligand 4
  ENSP ID: ENSP00000479974
MKLCVTVLSLLMLVAAFCSPALSAPNSKPKEASKSVLIPVNPGSRSTCMTWN

SEQ ID NO: 14640 - protein, 92 aa, Homo sapiens; identical to SEQ ID NO: 14638
  Payload ID: 2854
  Gene Symbol: CCL4
  Gene Name: chemokine (C-C motif) ligand 4
  Uniprot ID: P13236
  ENSP ID: ENSP00000480345

SEQ ID NO: 14641 - protein, 52 aa, Homo sapiens; identical to SEQ ID NO: 14639
  Payload ID: 2854
  Gene Symbol: CCL4
  Gene Name: chemokine (C-C motif) ligand 4
  ENSP ID: ENSP00000480569

SEQ ID NO: 14642 - protein, 92 aa, Homo sapiens; identical to SEQ ID NO: 14638
  Payload ID: 2854
  Gene Symbol: CCL4
  Gene Name: chemokine (C-C motif) ligand 4
  Uniprot ID: P13236
  ENSP ID: ENSP00000482259

SEQ ID NO: 14643 - protein, 52 aa, Homo sapiens; identical to SEQ ID NO: 14639
  Payload ID: 2854
  Gene Symbol: CCL4
  Gene Name: chemokine (C-C motif) ligand 4
  ENSP ID: ENSP00000483068

SEQ ID NO: 14644 - protein, 92 aa, Homo sapiens
  Payload ID: 2855
  Gene Symbol: CCL4L2
  Gene Name: chemokine (C-C motif) ligand 4-like 2
  ENSP ID: ENSP00000478181
MKLCVTVLSLLVLVAAFCSLALSAPMGSDPPTACCFSYTARKLPRNFVVDYYETSSLCSQPAVPWDSNLGKQVCADPSESWVQEYVYDLELN

SEQ ID NO: 14645 - protein, 92 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000478376
MKLCVTVLSLLVLVAAFCSLALSAPMGSDPPTACCFSYTARKLPRNFVVDYYETSSLCSQPAVVFQTKRGKQVCADPSESWVQEYVYDLELN

SEQ ID NO: 14646 - protein, 92 aa, Homo sapiens; identical to SEQ ID NO: 14645
  Payload ID: 2855
  Gene Symbol: CCL4L2
  Gene Name: chemokine (C-C motif) ligand 4-like 2
  Uniprot ID: Q8NHW4
  ENSP ID: ENSP00000479126

SEQ ID NO: 14647 - protein, 87 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000479354
MKLCVTVLSLLVLVAAFCSLALSAPMGSDPPTACCFSYTARKLPRNFVVDYYETSSLCSQPAVVGKQVCADPSESWVQEYVYDLELN

SEQ ID NO: 14648 - protein, 103 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000479774
MKLCVTVLSLLVLVAAFCSLALSAPMGSDPPTACCFSYTARKLPRNFVVDYYETSSLCSQPAVVYRESASSAAPGRIPSTRAAPHGPWSGRGRCLPQARDKAR

SEQ ID NO: 14649 - protein, 47 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000479833
MKLCVTVLSLLVLVAAFCSLALSAPKASKSALTPVSPGSRSTCMTWN

SEQ ID NO: 14650 - protein, 64 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000480089
MKLCVTVLSLLVLVAAFCSLALSAPMGSDPPTACCFSYTARKLPRNFVVDYYETSSLCSQPAVV

SEQ ID NO: 14651 - protein, 47 aa, Homo sapiens; identical to SEQ ID NO: 14649
  Payload ID: 2855
  Gene Symbol: CCL4L2
  Gene Name: chemokine (C-C motif) ligand 4-like 2
  Uniprot ID: Q8NHW4
  ENSP ID: ENSP00000481323

SEQ ID NO: 14652 - protein, 52 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000481727
MKLCVTVLSLLVLVAAFCSLALSAPNSKPKEASKSALTPVSPGSRSTCMTWN

SEQ ID NO: 14653 - protein, 64 aa, Homo sapiens; identical to SEQ ID NO: 14650
  Payload ID: 2855
  Gene Symbol: CCL4L2
  Gene Name: chemokine (C-C motif) ligand 4-like 2
  Uniprot ID: Q8NHW4
  ENSP ID: ENSP00000481969

SEQ ID NO: 14654 - protein, 96 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000482862
MKLCVTVLSLLVLVAAFCSLALSAPMGSDPPTACCFSYTARKLPRNFVVDYYETSSLCSQPAVVAAPGRIPSTRAAPHGPWSGRGRCLPQARDKAR

SEQ ID NO: 14655 - protein, 96 aa, Homo sapiens; identical to SEQ ID NO: 14654
  Payload ID: 2855
  Gene Symbol: CCL4L2
  Gene Name: chemokine (C-C motif) ligand 4-like 2
  Uniprot ID: Q8NHW4
  ENSP ID: ENSP00000483206

SEQ ID NO: 14656 - protein, 103 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000483330
MKLCVTVLSLLVLVAAFCSLALSAPMGSDPPTACCFSYTARKLPRNFVVDYYETSSLCSQPAVVEWKLQGVCFQCCSGKDPIHQSCPTWTMVRQRKMPTTGKG

SEQ ID NO: 14657 - protein, 92 aa, Homo sapiens; identical to SEQ ID NO: 14645
  Payload ID: 2855
  Gene Symbol: CCL4L2
  Gene Name: chemokine (C-C motif) ligand 4-like 2
  Uniprot ID: Q8NHW4
  ENSP ID: ENSP00000483609

SEQ ID NO: 14658 - protein, 86 aa, Homo sapiens
  Payload ID: 2855
  Gene Symbol: CCL4L2
  Gene Name: chemokine (C-C motif) ligand 4-like 2
  ENSP ID: ENSP00000484148
MKLCVTVLSLLVLVAAFCSLALSAPMGSDPPTACCFSYTARKLPRNFVVDYYETSSLCSQPAVVAAPHGPWSGRGRCLPQARDKAR

SEQ ID NO: 14659 - protein, 92 aa, Homo sapiens; identical to SEQ ID NO: 14645
  Payload ID: 2855
  Gene Symbol: CCL4L2
  Gene Name: chemokine (C-C motif) ligand 4-like 2
  ENSP ID: ENSP00000484322

SEQ ID NO: 14660 - protein, 68 aa, Homo sapiens
  Payload ID: 2855
  Gene Symbol: CCL4L2
  Gene Name: chemokine (C-C motif) ligand 4-like 2
  Uniprot ID: Q8NHW4
  ENSP ID: ENSP00000484455
MKLCVTVLSLLVLVAAFCSLALSAPTKSSEWKLQGVCFQCCSGKDPIHQSCPTWTMVRQRKMPTTGKG

SEQ ID NO: 14661 - protein, 86 aa, Homo sapiens; identical to SEQ ID NO: 14658
  Payload ID: 2855
  Gene Symbol: CCL4L2
  Gene Name: chemokine (C-C motif) ligand 4-like 2
  Uniprot ID: Q8NHW4
  ENSP ID: ENSP00000484498

SEQ ID NO: 14662 - protein, 96 aa, Homo sapiens; identical to SEQ ID NO: 14654
  Payload ID: 2855
  Gene Symbol: CCL4L2
  Gene Name: chemokine (C-C motif) ligand 4-like 2
  ENSP ID: ENSP00000487651

SEQ ID NO: 14663 - protein, 64 aa, Homo sapiens; identical to SEQ ID NO: 14650
  Payload ID: 2855
  Gene Symbol: CCL4L2
  Gene Name: chemokine (C-C motif) ligand 4-like 2
  Uniprot ID: Q8NHW4
  ENSP ID: ENSP00000487715

SEQ ID NO: 14664 - protein, 103 aa, Homo sapiens; identical to SEQ ID NO: 14648
  Payload ID: 2855
  Gene Symbol: CCL4L2
  Gene Name: chemokine (C-C motif) ligand 4-like 2
  ENSP ID: ENSP00000487792

SEQ ID NO: 14665 - protein, 103 aa, Homo sapiens [sequence omitted]

SEQ ID NO: 14666 - protein, 87 aa, Homo sapiens; identical to SEQ ID NO: 14647
  Payload ID: 2855
  Gene Symbol: CCL4L2
  Gene Name: chemokine (C-C motif) ligand 4-like 2
  Uniprot ID: Q8NHW4
  ENSP ID: ENSP00000487859

SEQ ID NO: 14667 - protein, 68 aa, Homo sapiens [sequence omitted]

SEQ ID NO: 14668 - protein, 103 aa, Homo sapiens; identical to SEQ ID NO: 14648
  Payload ID: 2855
  Gene Symbol: CCL4L2
  Gene Name: chemokine (C-C motif) ligand 4-like 2
  Uniprot ID: Q8NHW4
  ENSP ID: ENSP00000487911

SEQ ID NO: 14669 - protein, 103 aa, Homo sapiens
  Payload ID: 2855
  Gene Symbol: CCL4L2
  Gene Name: chemokine (C-C motif) ligand 4-like 2
  ENSP ID: ENSP00000487961
MKLCVTVLSLLVLVAAFCSLALSAPMGSDPPTACCFSYTARKLPRNFVVDYYETSSLCSQPAVVYRESASSAARGRIPSTRAAPHGPWSGRGRCLPQARDKAR

SEQ ID NO: 14670 - protein, 64 aa, Homo sapiens; identical to SEQ ID NO: 14650
  Payload ID: 2855
  Gene Symbol: CCL4L2
  Gene Name: chemokine (C-C motif) ligand 4-like 2
  ENSP ID: ENSP00000488094

SEQ ID NO: 14671 - protein, 86 aa, Homo sapiens; identical to SEQ ID NO: 14658
  Payload ID: 2855
  Gene Symbol: CCL4L2
  Gene Name: chemokine (C-C motif) ligand 4-like 2
  Uniprot ID: Q8NHW4
  ENSP ID: ENSP00000488231

SEQ ID NO: 14672 - protein, 87 aa, Homo sapiens; identical to SEQ ID NO: 14647
  Payload ID: 2855
  Gene Symbol: CCL4L2
  Gene Name: chemokine (C-C motif) ligand 4-like 2
  Uniprot ID: Q8NHW4
  ENSP ID: ENSP00000488366

SEQ ID NO: 14673 - protein, 47 aa, Homo sapiens; identical to SEQ ID NO: 14649
  Payload ID: 2855
  Gene Symbol: CCL4L2
  Gene Name: chemokine (C-C motif) ligand 4-like 2
  ENSP ID: ENSP00000488369

SEQ ID NO: 14674 - protein, 68 aa, Homo sapiens; identical to SEQ ID NO: 14660
  Payload ID: 2855
  Gene Symbol: CCL4L2
  Gene Name: chemokine (C-C motif) ligand 4-like 2
  Uniprot ID: Q8NHW4
  ENSP ID: ENSP00000488430

SEQ ID NO: 14675 - protein, 103 aa, Homo sapiens; identical to SEQ ID NO: 14656
  Payload ID: 2855
  Gene Symbol: CCL4L2
  Gene Name: chemokine (C-C motif) ligand 4-like 2
  Uniprot ID: Q8NHW4
  ENSP ID: ENSP00000488439

SEQ ID NO: 14676 - protein, 86 aa, Homo sapiens; identical to SEQ ID NO: 14658
  Payload ID: 2855
  Gene Symbol: CCL4L2
  Gene Name: chemokine (C-C motif) ligand 4-like 2
  Uniprot ID: Q8NHW4
  ENSP ID: ENSP00000488541

SEQ ID NO: 14677 - protein, 47 aa, Homo sapiens; identical to SEQ ID NO: 14649
  Payload ID: 2855
  Gene Symbol: CCL4L2
  Gene Name: chemokine (C-C motif) ligand 4-like 2
  Uniprot ID: Q8NHW4
  ENSP ID: ENSP00000488687

SEQ ID NO: 14678 - protein, 96 aa, Homo sapiens [sequence omitted]

SEQ ID NO: 14679 - protein, 103 aa, Homo sapiens; identical to SEQ ID NO: 14656
  Payload ID: 2855
  Gene Symbol: CCL4L2
  Gene Name: chemokine (C-C motif) ligand 4-like 2
  ENSP ID: ENSP00000488719

SEQ ID NO: 14680 - protein, 64 aa, Homo sapiens; identical to SEQ ID NO: 14650
  Payload ID: 2855
  Gene Symbol: CCL4L2
  Gene Name: chemokine (C-C motif) ligand 4-like 2
  Uniprot ID: Q8NHW4
  ENSP ID: ENSP00000488736

SEQ ID NO: 14681 - protein, 64 aa, Homo sapiens; identical to SEQ ID NO: 14650
  Payload ID: 2855
  Gene Symbol: CCL4L2
  Gene Name: chemokine (C-C motif) ligand 4-like 2
  Uniprot ID: Q8NHW4
  ENSP ID: ENSP00000488758

SEQ ID NO: 14682 - protein, 64 aa, Homo sapiens; identical to SEQ ID NO: 14650
  Payload ID: 2855
  Gene Symbol: CCL4L2
  Gene Name: chemokine (C-C motif) ligand 4-like 2
  ENSP ID: ENSP00000488897

SEQ ID NO: 14683 - protein, 150 aa, Homo sapiens
  Payload ID: 2856
  Gene Symbol: CCL5
  Gene Name: chemokine (C-C motif) ligand 5
  ENSP ID: ENSP00000474141
  MOD_RES (1)..(1): Any amino acid
XAALAVILIATALCAPASASPYSSDTTPCCFAYIARPLPRAHIKEYFYTSGKCSNPAVVHRSRMPKREGQQVWQDFLYDSRLNKGKLCHPKEPPSVCQPREEMGSGVHQLFGDELGWRVLEPELTQICLFLLALVLAWEASPHYPTPPAP

SEQ ID NO: 14684 - protein, 91 aa, Homo sapiens
  Payload ID: 2856
  Gene Symbol: CCL5
  Gene Name: chemokine (C-C motif) ligand 5
  Uniprot ID: P13501
  ENSP ID: ENSP00000474412
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 14685 - protein, 91 aa, Homo sapiens; identical to SEQ ID NO: 14684
  Payload ID: 2856
  Gene Symbol: CCL5
  Gene Name: chemokine (C-C motif) ligand 5
  Uniprot ID: P13501
  ENSP ID: ENSP00000475057

SEQ ID NO: 14686 - protein, 91 aa, Homo sapiens; identical to SEQ ID NO: 14684
  Payload ID: 2856
  Gene Symbol: CCL5
  Gene Name: chemokine (C-C motif) ligand 5
  Uniprot ID: P13501
  ENSP ID: ENSP00000479894

SEQ ID NO: 14687 - protein, 91 aa, Homo sapiens; identical to SEQ ID NO: 14684
  Payload ID: 2856
  Gene Symbol: CCL5
  Gene Name: chemokine (C-C motif) ligand 5
  ENSP ID: ENSP00000484921

SEQ ID NO: 14688 - protein, 150 aa, Homo sapiens; identical to SEQ ID NO: 14683
  Payload ID: 2856
  Gene Symbol: CCL5
  Gene Name: chemokine (C-C motif) ligand 5
  ENSP ID: ENSP00000488072
  MOD_RES (1)..(1): Any amino acid

SEQ ID NO: 14689 - protein, 99 aa, Homo sapiens
  Payload ID: 2857
  Gene Symbol: CCL7
  Gene Name: chemokine (C-C motif) ligand 7
  Uniprot ID: P80098
  ENSP ID: ENSP00000367832
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 14690 - protein, 81 aa, Homo sapiens
  Payload ID: 2857
  Gene Symbol: CCL7
  Gene Name: chemokine (C-C motif) ligand 7
  ENSP ID: ENSP00000378124
MKASAALLCLLLTAAAFSPQGLAQPERPRTHPQWTFLLVVSLQLGLILQLPAATDLSIRKSLSRGWRATEGPPVATVPGKL

SEQ ID NO: 14691 - protein, 47 aa, Homo sapiens
  Payload ID: 2857
  Gene Symbol: CCL7
  Gene Name: chemokine (C-C motif) ligand 7
  ENSP ID: ENSP00000378126
MKASAALLCLLLTAAAFSPQGLAQPASRPNWTRRSVLTPHRSGSRTL

SEQ ID NO: 14692 - protein, 99 aa, Homo sapiens
  Payload ID: 2858
  Gene Symbol: CCL8
  Gene Name: chemokine (C-C motif) ligand 8
  Uniprot ID: P80075
  ENSP ID: ENSP00000378118
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 14693 - protein, 355 aa, Homo sapiens
  Payload ID: 2859
  Gene Symbol: CCR1
  Gene Name: chemokine (C-C motif) receptor 1
  Uniprot ID: P32246
  ENSP ID: ENSP00000296140
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 14694 - protein, 362 aa, Homo sapiens
  Payload ID: 2860
  Gene Symbol: CCR10
  Gene Name: chemokine (C-C motif) receptor 10
  Uniprot ID: P46092
  ENSP ID: ENSP00000332504
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 14695 - protein, 83 aa, Homo sapiens
  Payload ID: 2860
  Gene Symbol: CCR10
  Gene Name: chemokine (C-C motif) receptor 10
  ENSP ID: ENSP00000467331
MVACYALLGRTLLAARGPERRRALRVVVALVAAFVVLQLPYSLALLLDTADLLAARERSCPASKRKDVALLVTSGLALARCGL

SEQ ID NO: 14696 - protein, 140 aa, Homo sapiens
  Payload ID: 2860
  Gene Symbol: CCR10
  Gene Name: chemokine (C-C motif) receptor 10
  ENSP ID: ENSP00000468135
MVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 14697 - protein, 374 aa, Homo sapiens
  Payload ID: 2861
  Gene Symbol: CCR2
  Gene Name: chemokine (C-C motif) receptor 2
  Uniprot ID: P41597
  ENSP ID: ENSP00000292301
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 14698 - protein, 374 aa, Homo sapiens; identical to SEQ ID NO: 14697
  Payload ID: 2861
  Gene Symbol: CCR2
  Gene Name: chemokine (C-C motif) receptor 2
  Uniprot ID: P41597
  ENSP ID: ENSP00000383681

SEQ ID NO: 14699 - protein, 121 aa, Homo sapiens
  Payload ID: 2861
  Gene Symbol: CCR2
  Gene Name: chemokine (C-C motif) receptor 2
  ENSP ID: ENSP00000396736
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYH

SEQ ID NO: 14700 - protein, 360 aa, Homo sapiens
  Payload ID: 2861
  Gene Symbol: CCR2
  Gene Name: chemokine (C-C motif) receptor 2
  Uniprot ID: P41597
  ENSP ID: ENSP00000399285
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 14701 - protein, 355 aa, Homo sapiens
  Payload ID: 2862
  Gene Symbol: CCR3
  Gene Name: chemokine (C-C motif) receptor 3
  Uniprot ID: P51677
  ENSP ID: ENSP00000350003
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 14702 - protein, 355 aa, Homo sapiens; identical to SEQ ID NO: 14701
  Payload ID: 2862
  Gene Symbol: CCR3
  Gene Name: chemokine (C-C motif) receptor 3
  Uniprot ID: P51677
  ENSP ID: ENSP00000379271

SEQ ID NO: 14703 - protein, 355 aa, Homo sapiens; identical to SEQ ID NO: 14701
  Payload ID: 2862
  Gene Symbol: CCR3
  Gene Name: chemokine (C-C motif) receptor 3
  Uniprot ID: P51677
  ENSP ID: ENSP00000379273

SEQ ID NO: 14704 - protein, 80 aa, Homo sapiens
  Payload ID: 2862
  Gene Symbol: CCR3
  Gene Name: chemokine (C-C motif) receptor 3
  ENSP ID: ENSP00000389336
MTTSLDTVETFGTTSYYDDVGLLCEKADTRALMAQFVPPLYSLVFTVGLLGNVVVVMILIKYRRLRIMTNIYLLNLAISD

SEQ ID NO: 14705 - protein, 21 aa, Homo sapiens
  Payload ID: 2862
  Gene Symbol: CCR3
  Gene Name: chemokine (C-C motif) receptor 3
  ENSP ID: ENSP00000401822
MTTSLDTVETFGTTSYYDDVG

SEQ ID NO: 14706 - protein, 376 aa, Homo sapiens
  Payload ID: 2862
  Gene Symbol: CCR3
  Gene Name: chemokine (C-C motif) receptor 3
  Uniprot ID: P51677
  ENSP ID: ENSP00000441600
MPFGIRMLLRAHKPGSSRRSEMTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 14707 - protein, 360 aa, Homo sapiens
  Payload ID: 2863
  Gene Symbol: CCR4
  Gene Name: chemokine (C-C motif) receptor 4
  Uniprot ID: P51679
  ENSP ID: ENSP00000332659
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 14708 - protein, 352 aa, Homo sapiens [sequence omitted]

SEQ ID NO: 14709 - protein, 352 aa, Homo sapiens [sequence omitted]

SEQ ID NO: 14710 - protein, 374 aa, Homo sapiens
  Payload ID: 2865
  Gene Symbol: CCR6
  Gene Name: chemokine (C-C motif) receptor 6
  Uniprot ID: P51684
  ENSP ID: ENSP00000339393
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 14711 - protein, 374 aa, Homo sapiens; identical to SEQ ID NO: 14710
  Payload ID: 2865
  Gene Symbol: CCR6
  Gene Name: chemokine (C-C motif) receptor 6
  Uniprot ID: P51684
  ENSP ID: ENSP00000343952

SEQ ID NO: 14712 - protein, 374 aa, Homo sapiens; identical to SEQ ID NO: 14710
  Payload ID: 2865
  Gene Symbol: CCR6
  Gene Name: chemokine (C-C motif) receptor 6
  Uniprot ID: P51684
  ENSP ID: ENSP00000383715

SEQ ID NO: 14713 - protein, 378 aa, Homo sapiens
  Payload ID: 2866
  Gene Symbol: CCR7
  Gene Name: chemokine (C-C motif) receptor 7
  Uniprot ID: P32248
  ENSP ID: ENSP00000246657
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 14714 - protein, 372 aa, Homo sapiens
  Payload ID: 2866
  Gene Symbol: CCR7
  Gene Name: chemokine (C-C motif) receptor 7
  ENSP ID: ENSP00000462631
MKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 14715 - protein, 199 aa, Homo sapiens
  Payload ID: 2866
  Gene Symbol: CCR7
  Gene Name: chemokine (C-C motif) receptor 7
  ENSP ID: ENSP00000463075
MYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAI

SEQ ID NO: 14716 - protein, 355 aa, Homo sapiens
  Payload ID: 2867
  Gene Symbol: CCR8
  Gene Name: chemokine (C-C motif) receptor 8
  Uniprot ID: P51685
  ENSP ID: ENSP00000326432
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 14717 - protein, 118 aa, Homo sapiens
  Payload ID: 2867
  Gene Symbol: CCR8
  Gene Name: chemokine (C-C motif) receptor 8
  ENSP ID: ENSP00000390104
MDYTLDLSVTTVTDYYYPDIFSSPCDAELIQTNDLLSAGPVGVWDCNVQSGVWLLLHWLLQQHVFHHPHECGQVPGCCPCRVCPKGEDDQDGHNAVPGSMANRHYGYHPIASVLPSGL

SEQ ID NO: 14718 - protein, 357 aa, Homo sapiens
  Payload ID: 2868
  Gene Symbol: CCR9
  Gene Name: chemokine (C-C motif) receptor 9
  Uniprot ID: P51686
  ENSP ID: ENSP00000348260
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 14719 - protein, 369 aa, Homo sapiens
  Payload ID: 2868
  Gene Symbol: CCR9
  Gene Name: chemokine (C-C motif) receptor 9
  Uniprot ID: P51686
  ENSP ID: ENSP00000350256
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 14720 - protein, 357 aa, Homo sapiens; identical to SEQ ID NO: 14718
  Payload ID: 2868
  Gene Symbol: CCR9
  Gene Name: chemokine (C-C motif) receptor 9
  Uniprot ID: P51686
  ENSP ID: ENSP00000379292

SEQ ID NO: 14721 - protein, 107 aa, Homo sapiens
  Payload ID: 2868
  Gene Symbol: CCR9
  Gene Name: chemokine (C-C motif) receptor 9
  ENSP ID: ENSP00000393267
MTPTDFTSPPGPAPDHLPSLAQESISFQDLSPGLTQALFLTWLMTMALNPHLPWKTTLTSTSLTSTVRKTMSGSLRAISSHPCTGSCSSWVPWATVLLSLSTGTAQE

SEQ ID NO: 14722 - protein, 356 aa, Homo sapiens
  Payload ID: 2869
  Gene Symbol: CCRL2
  Gene Name: chemokine (C-C motif) receptor-like 2
  Uniprot ID: O00421
  ENSP ID: ENSP00000349967
MIYTRFLKGSLKMANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 14723 - protein, 344 aa, Homo sapiens
  Payload ID: 2869
  Gene Symbol: CCRL2
  Gene Name: chemokine (C-C motif) receptor-like 2
  Uniprot ID: O00421
  ENSP ID: ENSP00000381994
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 14724 - protein, 344 aa, Homo sapiens; identical to SEQ ID NO: 14723
  Payload ID: 2869
  Gene Symbol: CCRL2
  Gene Name: chemokine (C-C motif) receptor-like 2
  Uniprot ID: O00421
  ENSP ID: ENSP00000383677

SEQ ID NO: 14725 - protein, 344 aa, Homo sapiens; identical to SEQ ID NO: 14723
  Payload ID: 2869
  Gene Symbol: CCRL2
  Gene Name: chemokine (C-C motif) receptor-like 2
  Uniprot ID: O00421
  ENSP ID: ENSP00000383678

SEQ ID NO: 14726 - protein, 217 aa, Homo sapiens
  Payload ID: 2869
  Gene Symbol: CCRL2
  Gene Name: chemokine (C-C motif) receptor-like 2
  ENSP ID: ENSP00000414957
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFT

SEQ ID NO: 14727 - protein, 397 aa, Homo sapiens
  Payload ID: 2870
  Gene Symbol: CX3CL1
  Gene Name: chemokine (C-X3-C motif) ligand 1
  Uniprot ID: P78423
  ENSP ID: ENSP00000006053
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 14728 - protein, 403 aa, Homo sapiens
  Payload ID: 2870
  Gene Symbol: CX3CL1
  Gene Name: chemokine (C-X3-C motif) ligand 1
  ENSP ID: ENSP00000456830
MAPISLSWLLRLATFCHLTVLLAGTSLNSGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 14729 - protein, 55 aa, Homo sapiens
  Payload ID: 2870
  Gene Symbol: CX3CL1
  Gene Name: chemokine (C-X3-C motif) ligand 1
  ENSP ID: ENSP00000457996
MAPISLSWLLRLATFCHLTVLLAAWRRDSTGCSVPTRRSNGSRTRCSIWTARLLP

SEQ ID NO: 14730 - protein, 359 aa, Homo sapiens
  Payload ID: 2870
  Gene Symbol: CX3CL1
  Gene Name: chemokine (C-X3-C motif) ligand 1
  ENSP ID: ENSP00000464114
MTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 14731 - protein, 387 aa, Homo sapiens
  Payload ID: 2871
  Gene Symbol: CX3CR1
  Gene Name: chemokine (C-X3-C motif) receptor 1
  Uniprot ID: P49238
  ENSP ID: ENSP00000351059
MREPLEAFKLADLDFRKSSLASGWRMASGAFTMDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 14732 - protein, 355 aa, Homo sapiens
  Payload ID: 2871
  Gene Symbol: CX3CR1
  Gene Name: chemokine (C-X3-C motif) receptor 1
  Uniprot ID: P49238
  ENSP ID: ENSP00000382166
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 14733 - protein, 166 aa, Homo sapiens
  Payload ID: 2871
  Gene Symbol: CX3CR1
  Gene Name: chemokine (C-X3-C motif) receptor 1
  ENSP ID: ENSP00000394960
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFM

SEQ ID NO: 14734 - protein, 106 aa, Homo sapiens
  Payload ID: 2871
  Gene Symbol: CX3CR1
  Gene Name: chemokine (C-X3-C motif) receptor 1
  ENSP ID: ENSP00000408835
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTT

SEQ ID NO: 14735 - protein, 355 aa, Homo sapiens; identical to SEQ ID NO: 14732
  Payload ID: 2871
  Gene Symbol: CX3CR1
  Gene Name: chemokine (C-X3-C motif) receptor 1
  Uniprot ID: P49238
  ENSP ID: ENSP00000439140

SEQ ID NO: 14736 - protein, 355 aa, Homo sapiens; identical to SEQ ID NO: 14732
  Payload ID: 2871
  Gene Symbol: CX3CR1
  Gene Name: chemokine (C-X3-C motif) receptor 1
  Uniprot ID: P49238
  ENSP ID: ENSP00000444928

SEQ ID NO: 14737 - protein, 107 aa, Homo sapiens
  Payload ID: 2872
  Gene Symbol: CXCL1
  Gene Name: chemokine (C-X-C motif) ligand 1 (melanoma growth stimulating activity, alpha)
  Uniprot ID: P09341
  ENSP ID: ENSP00000379110
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 14738 - protein, 98 aa, Homo sapiens
  Payload ID: 2873
  Gene Symbol: CXCL10
  Gene Name: chemokine (C-X-C motif) ligand 10
  Uniprot ID: P02778
  ENSP ID: ENSP00000305651
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 14739 - protein, 94 aa, Homo sapiens
  Payload ID: 2874
  Gene Symbol: CXCL11
  Gene Name: chemokine (C-X-C motif) ligand 11
  Uniprot ID: O14625
  ENSP ID: ENSP00000306884
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 14740 - protein, 94 aa, Homo sapiens; identical to SEQ ID NO: 14739
  Payload ID: 2874
  Gene Symbol: CXCL11
  Gene Name: chemokine (C-X-C motif) ligand 11
  Uniprot ID: O14625
  ENSP ID: ENSP00000425819

SEQ ID NO: 14741 - protein, 89 aa, Homo sapiens
  Payload ID: 2875
  Gene Symbol: CXCL12
  Gene Name: chemokine (C-X-C motif) ligand 12
  Uniprot ID: P48061
  ENSP ID: ENSP00000339913
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 14742 - protein, 119 aa, Homo sapiens
  Payload ID: 2875
  Gene Symbol: CXCL12
  Gene Name: chemokine (C-X-C motif) ligand 12
  Uniprot ID: P48061
  ENSP ID: ENSP00000363548
MNAKVVVVLVLVLTALCLSDGKPVSLSYRCPCRFFESHVARANVKHLKILNTPNCALQIVARLKNNNRQVCIDPKLKWIQEYLEKALNKGRREEKVGKKEKIGKKKRQKKRKAAQKRKN

SEQ ID NO: 14743 - protein, 93 aa, Homo sapiens
  Payload ID: 2875
  Gene Symbol: CXCL12
  Gene Name: chemokine (C-X-C motif) ligand 12
  Uniprot ID: P48061
  ENSP ID: ENSP00000363551
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 14744 - protein, 103 aa, Homo sapiens
  Payload ID: 2875
  Gene Symbol: CXCL12
  Gene Name: chemokine (C-X-C motif) ligand 12
  Uniprot ID: P48061
  ENSP ID: ENSP00000379139
MNAKVVVVLVLVLTALCLSDGKPVSLSYRCPCRFFESHYCTCLIRVSFHGATPLTQGSWVLYSLSCAGGETGLREPGPMVSPRVESHQEGRLGVPGPVNLGKA

SEQ ID NO: 14745 - protein, 140 aa, Homo sapiens
  Payload ID: 2875
  Gene Symbol: CXCL12
  Gene Name: chemokine (C-X-C motif) ligand 12
  Uniprot ID: P48061
  ENSP ID: ENSP00000379140
MNAKVVVVLVLVLTALCLSDGKPVSLSYRCPCRFFESHVARANVKHLKILNTPNCALQIVARLKNNNRQVCIDPKLKWIQEYLEKALNNLISAAPAGKRVIAGARALHPSPPRACPTARALCEIRLWPPPEWSWPSPGDV

SEQ ID NO: 14746 - protein, 103 aa, Homo sapiens; identical to SEQ ID NO: 14744
  Payload ID: 2875
  Gene Symbol: CXCL12
  Gene Name: chemokine (C-X-C motif) ligand 12
  Uniprot ID: P48061
  ENSP ID: ENSP00000379141

SEQ ID NO: 14747 - protein, 109 aa, Homo sapiens
  Payload ID: 2876
  Gene Symbol: CXCL13
  Gene Name: chemokine (C-X-C motif) ligand 13
  Uniprot ID: O43927
  ENSP ID: ENSP00000286758
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 14748 - protein, 111 aa, Homo sapiens
  Payload ID: 2877
  Gene Symbol: CXCL14
  Gene Name: chemokine (C-X-C motif) ligand 14
  Uniprot ID: O95715
  ENSP ID: ENSP00000337065
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 14749 - protein, 99 aa, Homo sapiens
  Payload ID: 2877
  Gene Symbol: CXCL14
  Gene Name: chemokine (C-X-C motif) ligand 14
  ENSP ID: ENSP00000423783
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 14750 - protein, 273 aa, Homo sapiens
  Payload ID: 2878
  Gene Symbol: CXCL16
  Gene Name: chemokine (C-X-C motif) ligand 16
  Uniprot ID: Q9H2A7
  ENSP ID: ENSP00000293778
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 14751 - protein, 273 aa, Homo sapiens; identical to SEQ ID NO: 14750
  Payload ID: 2878
  Gene Symbol: CXCL16
  Gene Name: chemokine (C-X-C motif) ligand 16
  Uniprot ID: Q9H2A7
  ENSP ID: ENSP00000459592

SEQ ID NO: 14752 - protein, 93 aa, Homo sapiens
  Payload ID: 2878
  Gene Symbol: CXCL16
  Gene Name: chemokine (C-X-C motif) ligand 16
  ENSP ID: ENSP00000460145
MNRLRKHLRAYHRCLYYTRFQLLSWSVCGGNKDPWVQELMSCLDLKECGHAYSGIVAHQKHLLPTSPPISQASEGASSDIHTPAQMLLSTLQS

SEQ ID NO: 14753 - protein, 62 aa, Homo sapiens
  Payload ID: 2879
  Gene Symbol: CXCL17
  Gene Name: chemokine (C-X-C motif) ligand 17
  ENSP ID: ENSP00000345317
MKVLISSLLLLLPLMLMSMVSSSLNPGVARGHRDRGQASRRWLQEGGQECECKAMLLFQIGS

SEQ ID NO: 14754 - protein, 119 aa, Homo sapiens
  Payload ID: 2879
  Gene Symbol: CXCL17
  Gene Name: chemokine (C-X-C motif) ligand 17
  Uniprot ID: Q6UXB2
  ENSP ID: ENSP00000472467
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 14755 - protein, 107 aa, Homo sapiens
  Payload ID: 2880
  Gene Symbol: CXCL2
  Gene Name: chemokine (C-X-C motif) ligand 2
  Uniprot ID: P19875
  ENSP ID: ENSP00000427279
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 14756 - protein, 107 aa, Homo sapiens
  Payload ID: 2881
  Gene Symbol: CXCL3
  Gene Name: chemokine (C-X-C motif) ligand 3
  Uniprot ID: P19876
  ENSP ID: ENSP00000296026
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 14757 - protein, 114 aa, Homo sapiens
  Payload ID: 2882
  Gene Symbol: CXCL5
  Gene Name: chemokine (C-X-C motif) ligand 5
  Uniprot ID: P42830
  ENSP ID: ENSP00000296027
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 14758 - protein, 114 aa, Homo sapiens
  Payload ID: 2883
  Gene Symbol: CXCL6
  Gene Name: chemokine (C-X-C motif) ligand 6
  Uniprot ID: P80162
  ENSP ID: ENSP00000226317
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 14759 - protein, 113 aa, Homo sapiens
  Payload ID: 2883
  Gene Symbol: CXCL6
  Gene Name: chemokine (C-X-C motif) ligand 6
  ENSP ID: ENSP00000424819
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDRYLSL

SEQ ID NO: 14760 - protein, 99 aa, Homo sapiens
  Payload ID: 2884
  Gene Symbol: CXCL8
  Gene Name: chemokine (C-X-C motif) ligand 8
  Uniprot ID: P10145
  ENSP ID: ENSP00000306512
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 14761 - protein, 95 aa, Homo sapiens
  Payload ID: 2884
  Gene Symbol: CXCL8
  Gene Name: chemokine (C-X-C motif) ligand 8
  ENSP ID: ENSP00000385908
MTSKLAVALLAAFLISAALCEGAVLPRSAKELRCQCIKTYSKPFHPKFIKELRVIESGPHCANTEIIVKLSDGRELCLDPKENWVQRVVEKFLKR

SEQ ID NO: 14762 - protein, 125 aa, Homo sapiens
  Payload ID: 2885
  Gene Symbol: CXCL9
  Gene Name: chemokine (C-X-C motif) ligand 9
  Uniprot ID: Q07325
  ENSP ID: ENSP00000354901
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 14763 - protein, 350 aa, Homo sapiens
  Payload ID: 2886
  Gene Symbol: CXCR1
  Gene Name: chemokine (C-X-C motif) receptor 1
  Uniprot ID: P25024
  ENSP ID: ENSP00000295683
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 14764 - protein, 360 aa, Homo sapiens
  Payload ID: 2887
  Gene Symbol: CXCR2
  Gene Name: chemokine (C-X-C motif) receptor 2
  Uniprot ID: P25025
  ENSP ID: ENSP00000319635
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 14765 - protein, 138 aa, Homo sapiens
  Payload ID: 2887
  Gene Symbol: CXCR2
  Gene Name: chemokine (C-X-C motif) receptor 2
  ENSP ID: ENSP00000392348
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLA

SEQ ID NO: 14766 - protein, 172 aa, Homo sapiens
  Payload ID: 2887
  Gene Symbol: CXCR2
  Gene Name: chemokine (C-X-C motif) receptor 2
  ENSP ID: ENSP00000392698
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGL

SEQ ID NO: 14767 - protein, 15 aa, Homo sapiens
  Payload ID: 2887
  Gene Symbol: CXCR2
  Gene Name: chemokine (C-X-C motif) receptor 2
  ENSP ID: ENSP00000410506
MEDFNMESDSFEDFW

SEQ ID NO: 14768 - protein, 200 aa, Homo sapiens
  Payload ID: 2887
  Gene Symbol: CXCR2
  Gene Name: chemokine (C-X-C motif) receptor 2
  ENSP ID: ENSP00000413686
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDM

SEQ ID NO: 14769 - protein, 135 aa, Homo sapiens
  Payload ID: 2887
  Gene Symbol: CXCR2
  Gene Name: chemokine (C-X-C motif) receptor 2
  ENSP ID: ENSP00000415148
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGIL

SEQ ID NO: 14770 - protein, 15 aa, Homo sapiens
  Payload ID: 2887
  Gene Symbol: CXCR2
  Gene Name: chemokine (C-X-C motif) receptor 2
  ENSP ID: ENSP00000416815
MEDFNMESDSFEDFW

SEQ ID NO: 14771 - protein, 415 aa, Homo sapiens
  Payload ID: 2888
  Gene Symbol: CXCR3
  Gene Name: chemokine (C-X-C motif) receptor 3
  Uniprot ID: P49682
  ENSP ID: ENSP00000362795
MELRKYGPGRLAGTVIGGAAQSKSQTKSDSITKEFLPGLYTAPSSPFPPSQVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 14772 - protein, 368 aa, Homo sapiens
  Payload ID: 2888
  Gene Symbol: CXCR3
  Gene Name: chemokine (C-X-C motif) receptor 3
  Uniprot ID: P49682
  ENSP ID: ENSP00000362797
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 14773 - protein, 352 aa, Homo sapiens
  Payload ID: 2889
  Gene Symbol: CXCR4
  Gene Name: chemokine (C-X-C motif) receptor 4
  Uniprot ID: P61073
  ENSP ID: ENSP00000241393
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 14774 - protein, 356 aa, Homo sapiens
  Payload ID: 2889
  Gene Symbol: CXCR4
  Gene Name: chemokine (C-X-C motif) receptor 4
  Uniprot ID: P61073
  ENSP ID: ENSP00000386884
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 14775 - protein, 372 aa, Homo sapiens
  Payload ID: 2890
  Gene Symbol: CXCR5
  Gene Name: chemokine (C-X-C motif) receptor 5
  Uniprot ID: P32302
  ENSP ID: ENSP00000292174
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 14776 - protein, 342 aa, Homo sapiens
  Payload ID: 2891
  Gene Symbol: CXCR6
  Gene Name: chemokine (C-X-C motif) receptor 6
  Uniprot ID: O00574
  ENSP ID: ENSP00000304414
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 14777 - protein, 342 aa, Homo sapiens; identical to SEQ ID NO: 14776
  Payload ID: 2891
  Gene Symbol: CXCR6
  Gene Name: chemokine (C-X-C motif) receptor 6
  Uniprot ID: O00574
  ENSP ID: ENSP00000395704

SEQ ID NO: 14778 - protein, 342 aa, Homo sapiens; identical to SEQ ID NO: 14776
  Payload ID: 2891
  Gene Symbol: CXCR6
  Gene Name: chemokine (C-X-C motif) receptor 6
  Uniprot ID: O00574
  ENSP ID: ENSP00000396218

SEQ ID NO: 14779 - protein, 342 aa, Homo sapiens; identical to SEQ ID NO: 14776
  Payload ID: 2891
  Gene Symbol: CXCR6
  Gene Name: chemokine (C-X-C motif) receptor 6
  Uniprot ID: O00574
  ENSP ID: ENSP00000396886

SEQ ID NO: 14780 - protein, 152 aa, Homo sapiens
  Payload ID: 2892
  Gene Symbol: CKLF
  Gene Name: chemokine-like factor
  Uniprot ID: Q9UBR5
  ENSP ID: ENSP00000264001
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 14781 - protein, 99 aa, Homo sapiens
  Payload ID: 2892
  Gene Symbol: CKLF
  Gene Name: chemokine-like factor
  Uniprot ID: Q9UBR5
  ENSP ID: ENSP00000264003
MDNVQPKIKHRPFCFSVKGHVKMLRLDIINSLVTTVFMLIVSVLALIPETTTLTVGGGVFALVTAVCCLADGALIYRKLLFNPSGPYQKKPVHEKKEVL

SEQ ID NO: 14782 - protein, 120 aa, Homo sapiens
  Payload ID: 2892
  Gene Symbol: CKLF
  Gene Name: chemokine-like factor
  Uniprot ID: Q9UBR5
  ENSP ID: ENSP00000290771
MDNVQPKIKHRPFCFSVKGHVKMLRLALTVTSMTFFIIAQAPEPYIVITGFEVTVILFFILLYVLRLDRLMKWLFWPLLVFALVTAVCCLADGALIYRKLLFNPSGPYQKKPVHEKKEVL

SEQ ID NO: 14783 - protein, 67 aa, Homo sapiens
  Payload ID: 2892
  Gene Symbol: CKLF
  Gene Name: chemokine-like factor
  Uniprot ID: Q9UBR5
  ENSP ID: ENSP00000355417
MDNVQPKIKHRPFCFSVKGHVKMLRLVFALVTAVCCLADGALIYRKLLFNPSGPYQKKPVHEKKEVL

SEQ ID NO: 14784 - protein, 113 aa, Homo sapiens
  Payload ID: 2892
  Gene Symbol: CKLF
  Gene Name: chemokine-like factor
  Uniprot ID: Q9UBR5
  ENSP ID: ENSP00000416678
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGLF

SEQ ID NO: 14785 - protein, 33 aa, Homo sapiens
  Payload ID: 2892
  Gene Symbol: CKLF
  Gene Name: chemokine-like factor
  ENSP ID: ENSP00000431270
MDNVQPKIKHRPFCFSVKGHVKMLRLHCLVVFM

SEQ ID NO: 14786 - protein, 126 aa, Homo sapiens
  Payload ID: 2893
  Gene Symbol: CBY1
  Gene Name: chibby homolog 1 (Drosophila)
  Uniprot ID: Q9Y3M2
  ENSP ID: ENSP00000216029
MPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 14787 - protein, 126 aa, Homo sapiens; identical to SEQ ID NO: 14786
  Payload ID: 2893
  Gene Symbol: CBY1
  Gene Name: chibby homolog 1 (Drosophila)
  Uniprot ID: Q9Y3M2
  ENSP ID: ENSP00000380026

SEQ ID NO: 14788 - protein, 101 aa, Homo sapiens
  Payload ID: 2893
  Gene Symbol: CBY1
  Gene Name: chibby homolog 1 (Drosophila)
  ENSP ID: ENSP00000412260
MPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDM

SEQ ID NO: 14789 - protein, 61 aa, Homo sapiens
  Payload ID: 2893
  Gene Symbol: CBY1
  Gene Name: chibby homolog 1 (Drosophila)
  ENSP ID: ENSP00000413934
MPFFGNTFSPKKTPPRKSASLSNLHSLDRSTREVELGLEYGSPTMNLAGQSLKFENGQWIA

SEQ ID NO: 14790 - protein, 169 aa, Homo sapiens
  Payload ID: 2893
  Gene Symbol: CBY1
  Gene Name: chibby homolog 1 (Drosophila)
  ENSP ID: ENSP00000478962
MDKCQKHDVECEKPDANEDSLCNSVHVQWPGEGSTGFAFIRPKMPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 14791 - protein, 242 aa, Homo sapiens
  Payload ID: 2894
  Gene Symbol: CBY3
  Gene Name: chibby homolog 3 (Drosophila)
  Uniprot ID: A6NI87
  ENSP ID: ENSP00000366173
MWASRDHLPEPDLGDAAPPGSPSSFWTSGLPRQERSTSRQRSRGSPSSTCVPYKVHALATFECSATSHASRLWQTLQQFWADHISRPFSPRRPPLRRMPSLSTFYLLDHNTRQAELGLAYGAPCMRLSNQAFVFRGGRWTTESQLARTRSPLLSRTAWGWKAQVQRSKSQVLLEENNYLKLQQELLIDMLTETMARMHLLEKQRNPEVIPTAAARAGQRKMRKRAGASAGVLMIQPCALDSQ

SEQ ID NO: 14792 - protein, 334 aa, Homo sapiens
  Payload ID: 2895
  Gene Symbol: CHN1
  Gene Name: chimerin 1
  Uniprot ID: P15882
  ENSP ID: ENSP00000295497
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 14793 - protein, 194 aa, Homo sapiens
  Payload ID: 2895
  Gene Symbol: CHN1
  Gene Name: chimerin 1
  ENSP ID: ENSP00000386322
MWGLIAQGVKCAVLEARKSKIKLAAGSVSDCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLK

SEQ ID NO: 14794 - protein, 275 aa, Homo sapiens
  Payload ID: 2895
  Gene Symbol: CHN1
  Gene Name: chimerin 1
  ENSP ID: ENSP00000386469
MATMGLLMLLTLAASPHFLSICFHHVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 14795 - protein, 433 aa, Homo sapiens
  Payload ID: 2895
  Gene Symbol: CHN1
  Gene Name: chimerin 1
  Uniprot ID: P15882
  ENSP ID: ENSP00000386470
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 14796 - protein, 459 aa, Homo sapiens
  Payload ID: 2895
  Gene Symbol: CHN1
  Gene Name: chimerin 1
  Uniprot ID: P15882
  ENSP ID: ENSP00000386741
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 14797 - protein, 164 aa, Homo sapiens
  Payload ID: 2895
  Gene Symbol: CHN1
  Gene Name: chimerin 1
  ENSP ID: ENSP00000392603
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCAVLEARKSKIKLAAGSVSDCGLNVHKQCSKMVPNDCKPDLKHVKKVYSCDLTT

SEQ ID NO: 14798 - protein, 23 aa, Homo sapiens
  Payload ID: 2895
  Gene Symbol: CHN1
  Gene Name: chimerin 1
  ENSP ID: ENSP00000405270
MALTLFDTDEYRPPVWKSYCFMA

SEQ ID NO: 14799 - protein, 186 aa, Homo sapiens
  Payload ID: 2895
  Gene Symbol: CHN1
  Gene Name: chimerin 1
  ENSP ID: ENSP00000409798
MRGGRNRDRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAY

SEQ ID NO: 14800 - protein, 185 aa, Homo sapiens
  Payload ID: 2895
  Gene Symbol: CHN1
  Gene Name: chimerin 1
  ENSP ID: ENSP00000410496
MATMGLLMLLTLAASPHFLSICFHHVCVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESA

SEQ ID NO: 14801 - protein, 173 aa, Homo sapiens
  Payload ID: 2895
  Gene Symbol: CHN1
  Gene Name: chimerin 1
  ENSP ID: ENSP00000411911
MWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLM

SEQ ID NO: 14802 - protein, 22 aa, Homo sapiens
  Payload ID: 2895
  Gene Symbol: CHN1
  Gene Name: chimerin 1
  ENSP ID: ENSP00000416316
MALTLFDTDEYRPPVWKSYYIL

SEQ ID NO: 14803 - protein, 468 aa, Homo sapiens
  Payload ID: 2896
  Gene Symbol: CHN2
  Gene Name: chimerin 2
  Uniprot ID: P52757
  ENSP ID: ENSP00000222792
MAASSNSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 14804 - protein, 260 aa, Homo sapiens
  Payload ID: 2896
  Gene Symbol: CHN2
  Gene Name: chimerin 2
  ENSP ID: ENSP00000386849
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEAREISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 14805 - protein, 174 aa, Homo sapiens
  Payload ID: 2896
  Gene Symbol: CHN2
  Gene Name: chimerin 2
  ENSP ID: ENSP00000386968
MAASSNSSLSGSSVSSVYSEPRSPRELPKYAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATL

SEQ ID NO: 14806 - protein, 197 aa, Homo sapiens
  Payload ID: 2896
  Gene Symbol: CHN2
  Gene Name: chimerin 2
  ENSP ID: ENSP00000387425
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRGLL

SEQ ID NO: 14807 - protein, 274 aa, Homo sapiens
  Payload ID: 2896
  Gene Symbol: CHN2
  Gene Name: chimerin 2
  Uniprot ID: P52757
  ENSP ID: ENSP00000394284
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 14808 - protein, 180 aa, Homo sapiens
  Payload ID: 2896
  Gene Symbol: CHN2
  Gene Name: chimerin 2
  ENSP ID: ENSP00000396867
NPIYEHIGYATLLREKVSRRLSRSKNEPRKTNVTHEEHTAVEKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLY

SEQ ID NO: 14809 - protein, 91 aa, Homo sapiens
  Payload ID: 2896
  Gene Symbol: CHN2
  Gene Name: chimerin 2
  ENSP ID: ENSP00000398326
  MOD_RES (1)..(1): Any amino acid
XDVKMAFDRDGEKADISANVYPDINIITGALKLYFRDLPIPVITYDTYSKFIDAAKISNADERLEAVHEVLMLLPPAHYETLRYLMIHLKK

SEQ ID NO: 14810 - protein, 124 aa, Homo sapiens
  Payload ID: 2896
  Gene Symbol: CHN2
  Gene Name: chimerin 2
  ENSP ID: ENSP00000400282
MAASSNSSLSGSSVSSDAEEYQPPIWKSYLYQLQQEAPRPKRIICPREVENRPKYYETLRYLMIHLKKVTMNEKDNFMNAENLGIVFGPTLMRPPEDSTLTTLHDMRYQKLIVQILIENEDVLF

SEQ ID NO: 14811 - protein, 228 aa, Homo sapiens
  Payload ID: 2896
  Gene Symbol: CHN2
  Gene Name: chimerin 2
  ENSP ID: ENSP00000406337
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSGLKSEGLYRVSGFTEHIEDVKMAFDREISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 14812 - protein, 187 aa, Homo sapiens
  Payload ID: 2896
  Gene Symbol: CHN2
  Gene Name: chimerin 2
  ENSP ID: ENSP00000409843
MTQTHRAKSASSCPNLLVPETWPHQVSASHAGRSKQPQGGILKINEEHRRGAIQDLLASPGFTFGKRVVFDSHCLKRQHTFADGLHSSCTSNAEEYQPPIWKSYLYQLQQEAPRPKRIICPREVENRPKYYGREFHGIISREQADELLGGVEGAYILRESQRQPGCYTLALRFGNQTLNYRLFHDGK

SEQ ID NO: 14813 - protein, 216 aa, Homo sapiens [sequence omitted]

SEQ ID NO: 14814 - protein, 189 aa, Homo sapiens
  Payload ID: 2896
  Gene Symbol: CHN2
  Gene Name: chimerin 2
  ENSP ID: ENSP00000440526
MAASSNSSLSGSSVSSDAEEYQPPIWKSYLYQLQQEAPRPKRIICPREVENRPKYYGREFHGIISREQADELLGGVEGAYILRESQRQPGCYTLALREISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 14815 - protein, 136 aa, Homo sapiens
  Payload ID: 2896
  Gene Symbol: CHN2
  Gene Name: chimerin 2
  ENSP ID: ENSP00000441183
  MOD_RES (1)..(1): Any amino acid
XRAKSASSCPNLLVPETWPHQVSASHAGRSKQPQGGILKINEEHRRGAIQMLKNTSLLYGNHTYISYSKRHLVPRESFVLGRWKTDQNIMEESFMGSSLGSRRMSFLEAWRVPTSLEKASGNQDATRWLSGLETRP

SEQ ID NO: 14816 - protein, 182 aa, Homo sapiens
  Payload ID: 2896
  Gene Symbol: CHN2
  Gene Name: chimerin 2
  ENSP ID: ENSP00000444063
MAASSNSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHYETLRYLMIHLKKVTMNEKDNFMNAENLGIVFGPTLMRPPEDSTLTTLHDMRYQKLIVQILIENEDVLF

SEQ ID NO: 14817 - protein, 37 aa, Homo sapiens
  Payload ID: 2896
  Gene Symbol: CHN2
  Gene Name: chimerin 2
  ENSP ID: ENSP00000462650
MTQTHRAKSASSCPNLLVPETWPHQVSASHAGRSKQP

SEQ ID NO: 14818 - protein, 332 aa, Homo sapiens
  Payload ID: 2896
  Gene Symbol: CHN2
  Gene Name: chimerin 2
  Uniprot ID: P52757
  ENSP ID: ENSP00000486515
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 14819 - protein, 447 aa, Homo sapiens
  Payload ID: 2897
  Gene Symbol: CHIT1
  Gene Name: chitinase 1 (chitotriosidase)
  Uniprot ID: Q13231
  ENSP ID: ENSP00000255427
MVRSVAWAGFMVLLMIPWGSAAKLVCYFTNWAQYRQGEARFLPKDLDPSLCTHLIYAFAGMTNHQLSTTEWNDETLYQEFNGLKKMFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 14820 - protein, 466 aa, Homo sapiens
  Payload ID: 2897
  Gene Symbol: CHIT1
  Gene Name: chitinase 1 (chitotriosidase)
  Uniprot ID: Q13231
  ENSP ID: ENSP00000356198
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 14821 - protein, 361 aa, Homo sapiens
  Payload ID: 2897
  Gene Symbol: CHIT1
  Gene Name: chitinase 1 (chitotriosidase)
  ENSP ID: ENSP00000421617
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVMLTLRQGDCKMTDVQAA

SEQ ID NO: 14822 - protein, 387 aa, Homo sapiens
  Payload ID: 2897
  Gene Symbol: CHIT1
  Gene Name: chitinase 1 (chitotriosidase)
  Uniprot ID: Q13231
  ENSP ID: ENSP00000423778
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELNG

SEQ ID NO: 14823 - protein, 383 aa, Homo sapiens
  Payload ID: 2898
  Gene Symbol: CHI3L1
  Gene Name: chitinase 3-like 1 (cartilage glycoprotein-39)
  Uniprot ID: P36222
  ENSP ID: ENSP00000255409
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 14824 - protein, 152 aa, Homo sapiens
  Payload ID: 2898
  Gene Symbol: CHI3L1
  Gene Name: chitinase 3-like 1 (cartilage glycoprotein-39)
  ENSP ID: ENSP00000385350
  MOD_RES (1)..(1): Any amino acid
XLLLSAALSAGKVTIDSSYDIAKISQHLDFISIMTYDFHGAWRGTTGHHSPLFRGQEDASPDRFSNTICDFLRGATVHRILGQQVPYATKGNQWVGYDDQESVKSKVQYLKDRQLAGAMVWALDLDDFQGSFCGQDLRFPLTNAIKDALAAT

SEQ ID NO: 14825 - protein, 380 aa, Homo sapiens
  Payload ID: 2899
  Gene Symbol: CHI3L2
  Gene Name: chitinase 3-like 2
  Uniprot ID: Q15782
  ENSP ID: ENSP00000358759
MGATTMDQKSLWAGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 14826 - protein, 390 aa, Homo sapiens
  Payload ID: 2899
  Gene Symbol: CHI3L2
  Gene Name: chitinase 3-like 2
  Uniprot ID: Q15782
  ENSP ID: ENSP00000358763
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 14827 - protein, 201 aa, Homo sapiens
  Payload ID: 2899
  Gene Symbol: CHI3L2
  Gene Name: chitinase 3-like 2
  ENSP ID: ENSP00000431968
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 14828 - protein, 145 aa, Homo sapiens
  Payload ID: 2899
  Gene Symbol: CHI3L2
  Gene Name: chitinase 3-like 2
  ENSP ID: ENSP00000431978
MLYQTINSLKTKFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYY

SEQ ID NO: 14829 - protein, 311 aa, Homo sapiens
  Payload ID: 2899
  Gene Symbol: CHI3L2
  Gene Name: chitinase 3-like 2
  Uniprot ID: Q15782
  ENSP ID: ENSP00000432049
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 14830 - protein, 161 aa, Homo sapiens
  Payload ID: 2899
  Gene Symbol: CHI3L2
  Gene Name: chitinase 3-like 2
  ENSP ID: ENSP00000433176
  MOD_RES (1)..(1): Any amino acid
XFTNWSQDRQEPGKFTPENIDPFLCSHLIYSFASIENNKVIIKDKSEVMLYQTINSLKTKNPKLKILLSIGGYLFGSKGDLDFINLLSFDFHGSWEKPLITGHNSPLSKGWQDRGPSSYYNVEYAVGYWIHKGMPSEKVVMGIPTYGHSFTLASAETTVGA

SEQ ID NO: 14831 - protein, 183 aa, Homo sapiens
  Payload ID: 2899
  Gene Symbol: CHI3L2
  Gene Name: chitinase 3-like 2
  ENSP ID: ENSP00000435250
PDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 14832 - protein, 42 aa, Homo sapiens
  Payload ID: 2899
  Gene Symbol: CHI3L2
  Gene Name: chitinase 3-like 2
  ENSP ID: ENSP00000435935
YEICQFLKGAKITRLQDQQVPYAVKGNQWVGYDDVKSMETKD

SEQ ID NO: 14833 - protein, 122 aa, Homo sapiens
  Payload ID: 2899
  Gene Symbol: CHI3L2
  Gene Name: chitinase 3-like 2
  ENSP ID: ENSP00000436006
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLA

SEQ ID NO: 14834 - protein, 220 aa, Homo sapiens
  Payload ID: 2899
  Gene Symbol: CHI3L2
  Gene Name: chitinase 3-like 2
  ENSP ID: ENSP00000436077
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEK

SEQ ID NO: 14835 - protein, 169 aa, Homo sapiens
  Payload ID: 2899
  Gene Symbol: CHI3L2
  Gene Name: chitinase 3-like 2
  ENSP ID: ENSP00000436272
MLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYA

SEQ ID NO: 14836 - protein, 182 aa, Homo sapiens
  Payload ID: 2899
  Gene Symbol: CHI3L2
  Gene Name: chitinase 3-like 2
  ENSP ID: ENSP00000436380
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDELAEAFQKDFTKSTKERLLLTAGVSAGRQMIDNSYQVEKLA

SEQ ID NO: 14837 - protein, 390 aa, Homo sapiens; identical to SEQ ID NO: 14826
  Payload ID: 2899
  Gene Symbol: CHI3L2
  Gene Name: chitinase 3-like 2
  Uniprot ID: Q15782
  ENSP ID: ENSP00000437082

SEQ ID NO: 14838 - protein, 311 aa, Homo sapiens; identical to SEQ ID NO: 14829
  Payload ID: 2899
  Gene Symbol: CHI3L2
  Gene Name: chitinase 3-like 2
  Uniprot ID: Q15782
  ENSP ID: ENSP00000437086

SEQ ID NO: 14839 - protein, 393 aa, Homo sapiens
  Payload ID: 2900
  Gene Symbol: CHID1
  Gene Name: chitinase domain containing 1
  Uniprot ID: Q9BWS9
  ENSP ID: ENSP00000325055
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 14840 - protein, 393 aa, Homo sapiens; identical to SEQ ID NO: 14839
  Payload ID: 2900
  Gene Symbol: CHID1
  Gene Name: chitinase domain containing 1
  Uniprot ID: Q9BWS9
  ENSP ID: ENSP00000388156

SEQ ID NO: 14841 - protein, 393 aa, Homo sapiens; identical to SEQ ID NO: 14839
  Payload ID: 2900
  Gene Symbol: CHID1
  Gene Name: chitinase domain containing 1
  Uniprot ID: Q9BWS9
  ENSP ID: ENSP00000391255

SEQ ID NO: 14842 - protein, 418 aa, Homo sapiens
  Payload ID: 2900
  Gene Symbol: CHID1
  Gene Name: chitinase domain containing 1
  Uniprot ID: Q9BWS9
  ENSP ID: ENSP00000398722
MRTLFNLLWLALACSPVHTTLSKSDAKKAASKTLLEKVKFCSCCPGWSAMARSWLTATSATQSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 14843 - protein, 362 aa, Homo sapiens
  Payload ID: 2900
  Gene Symbol: CHID1
  Gene Name: chitinase domain containing 1
  Uniprot ID: Q9BWS9
  ENSP ID: ENSP00000416034
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 14844 - protein, 108 aa, Homo sapiens
  Payload ID: 2900
  Gene Symbol: CHID1
  Gene Name: chitinase domain containing 1
  ENSP ID: ENSP00000431169
  MOD_RES (1)..(1): Any amino acid
XPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 14845 - protein, 84 aa, Homo sapiens
  Payload ID: 2900
  Gene Symbol: CHID1
  Gene Name: chitinase domain containing 1
  ENSP ID: ENSP00000431356
  MOD_RES (1)..(1): Any amino acid
XDAREPVVGARYIQTLKDHRPRMVWDSQASEHFFEYKKSRSGRHVVFYPTLKSLQVRLELARELGVGVSIWELGQGLDYFYDLL

SEQ ID NO: 14846 - protein, 26 aa, Homo sapiens
  Payload ID: 2900
  Gene Symbol: CHID1
  Gene Name: chitinase domain containing 1
  ENSP ID: ENSP00000431766
MRTLFNLLWLALACSPVHTTLSKSDA

SEQ ID NO: 14847 - protein, 84 aa, Homo sapiens
  Payload ID: 2900
  Gene Symbol: CHID1
  Gene Name: chitinase domain containing 1
  ENSP ID: ENSP00000432431
MRTLFNLLWLALACSPVHTTLSKSDAKKAASKTLLEKAGAQWRDLGSPQPLPPRFKRFSCFSLPSSWDYRVSFQISRCKTGVWW

SEQ ID NO: 14848 - protein, 162 aa, Homo sapiens
  Payload ID: 2900
  Gene Symbol: CHID1
  Gene Name: chitinase domain containing 1
  ENSP ID: ENSP00000432697
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGSHPSCLTVLAPQAEKSGGCELSGSMPRACT

SEQ ID NO: 14849 - protein, 84 aa, Homo sapiens
  Payload ID: 2900
  Gene Symbol: CHID1
  Gene Name: chitinase domain containing 1
  ENSP ID: ENSP00000433570
MRTLFNLLWLALACSPVHTTLSKSDAKKAASKTLLEKSQFSDKPVQDRGLVVTDLKAESVVLEHRSYCSAKARDRHFAGDVLGY

SEQ ID NO: 14850 - protein, 69 aa, Homo sapiens
  Payload ID: 2900
  Gene Symbol: CHID1
  Gene Name: chitinase domain containing 1
  ENSP ID: ENSP00000433879
LKDHRPRMVWDSQASEHFFEYKKSRSGRHVVFYPTLKSLQVRLELARELGVGVSIWELGQGLDYFYDLL

SEQ ID NO: 14851 - protein, 224 aa, Homo sapiens
  Payload ID: 2900
  Gene Symbol: CHID1
  Gene Name: chitinase domain containing 1
  ENSP ID: ENSP00000434651
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGAR

SEQ ID NO: 14852 - protein, 72 aa, Homo sapiens
  Payload ID: 2900
  Gene Symbol: CHID1
  Gene Name: chitinase domain containing 1
  ENSP ID: ENSP00000435336
  MOD_RES (1)..(1): Any amino acid
XQLGMFTHKEFEQLAPVLDGFSLMTYDYSTAHQPGPNAPLSWVRACVQVLDPKSKWRSKILLGLNFYGTSRH

SEQ ID NO: 14853 - protein, 418 aa, Homo sapiens; identical to SEQ ID NO: 14842
  Payload ID: 2900
  Gene Symbol: CHID1
  Gene Name: chitinase domain containing 1
  Uniprot ID: Q9BWS9
  ENSP ID: ENSP00000435503

SEQ ID NO: 14854 - protein, 38 aa, Homo sapiens
  Payload ID: 2900
  Gene Symbol: CHID1
  Gene Name: chitinase domain containing 1
  ENSP ID: ENSP00000435607
MRTLFNLLWLALACSPVHTTLSKSDAKKAASKTLLEKV

SEQ ID NO: 14855 - protein, 119 aa, Homo sapiens
  Payload ID: 2900
  Gene Symbol: CHID1
  Gene Name: chitinase domain containing 1
  ENSP ID: ENSP00000435731
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGRE

SEQ ID NO: 14856 - protein, 131 aa, Homo sapiens
  Payload ID: 2900
  Gene Symbol: CHID1
  Gene Name: chitinase domain containing 1
  ENSP ID: ENSP00000436017
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQ

SEQ ID NO: 14857 - protein, 115 aa, Homo sapiens
  Payload ID: 2900
  Gene Symbol: CHID1
  Gene Name: chitinase domain containing 1
  ENSP ID: ENSP00000436752
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKR

SEQ ID NO: 14858 - protein, 101 aa, Homo sapiens
  Payload ID: 2901
  Gene Symbol: CHIA
  Gene Name: chitinase, acidic
  ENSP ID: ENSP00000271312
MVSTPENRQTFITSVIKFLRQYEFDGLDFDWEYPGSRGSPPQDKHLFTVLVQMRKLKYREDLSNLPKITQLVGIITSSAVWPQSPLLLSITLGCPLLLRNA

SEQ ID NO: 14859 - protein, 315 aa, Homo sapiens
  Payload ID: 2901
  Gene Symbol: CHIA
  Gene Name: chitinase, acidic
  Uniprot ID: Q9BZP6
  ENSP ID: ENSP00000338970
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 14860 - protein, 476 aa, Homo sapiens [sequence omitted]

SEQ ID NO: 14861 - protein, 476 aa, Homo sapiens [sequence omitted]

SEQ ID NO: 14862 - protein, 420 aa, Homo sapiens
  Payload ID: 2901
  Gene Symbol: CHIA
  Gene Name: chitinase, acidic
  ENSP ID: ENSP00000387671
ETSSSVHEQVADSGAQAVAFQSGGESSIVWNSQLKTLLAIGGWNFGTAPFTAMVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 14863 - protein, 315 aa, Homo sapiens; identical to SEQ ID NO: 14859
  Payload ID: 2901
  Gene Symbol: CHIA
  Gene Name: chitinase, acidic
  Uniprot ID: Q9BZP6
  ENSP ID: ENSP00000390476

SEQ ID NO: 14864 - protein, 368 aa, Homo sapiens
  Payload ID: 2901
  Gene Symbol: CHIA
  Gene Name: chitinase, acidic
  Uniprot ID: Q9BZP6
  ENSP ID: ENSP00000391132
MVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFWHCVNGVTYQQNCQAGLVFDTSCDCCNWA

SEQ ID NO: 14865 - protein, 287 aa, Homo sapiens
  Payload ID: 2901
  Gene Symbol: CHIA
  Gene Name: chitinase, acidic
  ENSP ID: ENSP00000433309
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNIKSFDIKAQWLKHNKFGGAMVWAIDLDDFTGTFCNQGKFPLISTLKKALGLQSASCTAPAQPIEPITAAPSGSGNGSGSSSSGGSSGGSGFCAVRANGLYPVANNRNAFW

SEQ ID NO: 14866 - protein, 315 aa, Homo sapiens; identical to SEQ ID NO: 14859
  Payload ID: 2901
  Gene Symbol: CHIA
  Gene Name: chitinase, acidic
  Uniprot ID: Q9BZP6
  ENSP ID: ENSP00000436946

SEQ ID NO: 14867 - protein, 77 aa, Homo sapiens
  Payload ID: 2902
  Gene Symbol: CTBS
  Gene Name: chitobiase, di-N-acetyl-
  ENSP ID: ENSP00000359659
MSRPQLRRWRLVSSPPSGVPGLALLALLALLALRLAAGTDCPCPEPELCRPIRHHPDFEVSAFLCSSRSGLQGTKRS

SEQ ID NO: 14868 - protein, 385 aa, Homo sapiens
  Payload ID: 2902
  Gene Symbol: CTBS
  Gene Name: chitobiase, di-N-acetyl-
  Uniprot ID: Q01459
  ENSP ID: ENSP00000359664
MSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKDPAGHFHQVWYDNPQSISLKATYIQNYRLRGIGMWNANCLDYSGDAVAKQQTEEMWEVLKPKLLQR

SEQ ID NO: 14869 - protein, 77 aa, Homo sapiens; identical to SEQ ID NO: 14867
  Payload ID: 2902
  Gene Symbol: CTBS
  Gene Name: chitobiase, di-N-acetyl-
  ENSP ID: ENSP00000452177

SEQ ID NO: 14870 - protein, 60 aa, Homo sapiens
  Payload ID: 2903
  Gene Symbol: CHKB-CPT1B
  Gene Name: CHKB-CPT1B readthrough (NMD candidate)
  ENSP ID: ENSP00000457031
EDLLVEVSRYALASHFFWGLWSILQASMSTIEFGYLDYAQSRFQFYFQQKGQLTSVHSSS

SEQ ID NO: 14871 - protein, 914 aa, Homo sapiens
  Payload ID: 2904
  Gene Symbol: CLCA1
  Gene Name: chloride channel accessory 1
  Uniprot ID: A8K7I4
  ENSP ID: ENSP00000234701
MGPFKSSVFILILHLLEGALSNSLIQLNNNGYEGIVVAIDPNVPEDETLIQQIKDMVTQASLYLLEATGKRFYFKNVAILIPETWKTKADYVRPKLETYKNADVLVAESTPPGNDEPYTEQMGNCGEKGERIHLTPDFIAGKKLAEYGPQGRAFVHEWAHLRWGVFDEYNNDEKFYLSNGRIQAVRCSAGITGTNVVKKCQGGSCYTKRCTFNKVTGLYEKGCEFVLQSRQTEKASIMFAQHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQNELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTMQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 14872 - protein, 914 aa, Homo sapiens; identical to SEQ ID NO: 14871
  Payload ID: 2904
  Gene Symbol: CLCA1
  Gene Name: chloride channel accessory 1
  Uniprot ID: A8K7I4
  ENSP ID: ENSP00000378200

SEQ ID NO: 14873 - protein, 943 aa, Homo sapiens
  Payload ID: 2905
  Gene Symbol: CLCA2
  Gene Name: chloride channel accessory 2
  Uniprot ID: Q9UQC9
  ENSP ID: ENSP00000359596
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 14874 - protein, 919 aa, Homo sapiens
  Payload ID: 2906
  Gene Symbol: CLCA4
  Gene Name: chloride channel accessory 4
  Uniprot ID: Q14CN2
  ENSP ID: ENSP00000359594
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSGVNISTLVLSVIGSVVIVNFILSTTI

SEQ ID NO: 14875 - protein, 430 aa, Homo sapiens
  Payload ID: 2907
  Gene Symbol: CLCC1
  Gene Name: chloride channel CLIC-like 1
  Uniprot ID: Q96S66
  ENSP ID: ENSP00000306552
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 14876 - protein, 366 aa, Homo sapiens
  Payload ID: 2907
  Gene Symbol: CLCC1
  Gene Name: chloride channel CLIC-like 1
  Uniprot ID: Q96S66
  ENSP ID: ENSP00000337243
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 14877 - protein, 551 aa, Homo sapiens
  Payload ID: 2907
  Gene Symbol: CLCC1
  Gene Name: chloride channel CLIC-like 1
  Uniprot ID: Q96S66
  ENSP ID: ENSP00000349456
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 14878 - protein, 366 aa, Homo sapiens; identical to SEQ ID NO: 14876
  Payload ID: 2907
  Gene Symbol: CLCC1
  Gene Name: chloride channel CLIC-like 1
  Uniprot ID: Q96S66
  ENSP ID: ENSP00000358985

SEQ ID NO: 14879 - protein, 430 aa, Homo sapiens; identical to SEQ ID NO: 14875
  Payload ID: 2907
  Gene Symbol: CLCC1
  Gene Name: chloride channel CLIC-like 1
  Uniprot ID: Q96S66
  ENSP ID: ENSP00000358986

SEQ ID NO: 14880 - protein, 501 aa, Homo sapiens
  Payload ID: 2907
  Gene Symbol: CLCC1
  Gene Name: chloride channel CLIC-like 1
  Uniprot ID: Q96S66
  ENSP ID: ENSP00000358987
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 14881 - protein, 262 aa, Homo sapiens
  Payload ID: 2907
  Gene Symbol: CLCC1
  Gene Name: chloride channel CLIC-like 1
  ENSP ID: ENSP00000358993
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISCAQSEASRVKQVGNLFQAWAFAVCDPVLLQVPVCPILVFCYS

SEQ ID NO: 14882 - protein, 203 aa, Homo sapiens
  Payload ID: 2908
  Gene Symbol: CLNS1A
  Gene Name: chloride channel, nucleotide -sensitive, 1A
  ENSP ID: ENSP00000263309
MSFLKSFPPPGPAEGLLRQQPDTEAVLNGKGLGTGTLYIAESRLSWLDGSGLGFSLEYPTISLHALSRDRSDCLGEHLYVMVNAKFEVEAMFTAMCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 14883 - protein, 49 aa, Homo sapiens
  Payload ID: 2908
  Gene Symbol: CLNS1A
  Gene Name: chloride channel, nucleotide -sensitive, 1A
  ENSP ID: ENSP00000432570
MSFLKSFPPPGPAEGLLRQQPDTEAVLNGKGLGTGTLYIAERRIKRTCC

SEQ ID NO: 14884 - protein, 179 aa, Homo sapiens
  Payload ID: 2908
  Gene Symbol: CLNS1A
  Gene Name: chloride channel, nucleotide -sensitive, 1A
  ENSP ID: ENSP00000433741
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHDGMEVDTTPTVAGQFEDADVDH

SEQ ID NO: 14885 - protein, 237 aa, Homo sapiens
  Payload ID: 2908
  Gene Symbol: CLNS1A
  Gene Name: chloride channel, nucleotide -sensitive, 1A
  Uniprot ID: P54105
  ENSP ID: ENSP00000433919
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVPSDKSALEAMFTAMCECQALHPDPEDEDSDDYDGEEYDVEAHEQGQGDIPTFYTYEEGLSHLTAEGQATLERLEGMLSQSVSSQYNMAGVRTEDSIRDYEDGMEVDTTPTVAGQFEDADVDH

SEQ ID NO: 14886 - protein, 237 aa, Homo sapiens; identical to SEQ ID NO: 14885
  Payload ID: 2908
  Gene Symbol: CLNS1A
  Gene Name: chloride channel, nucleotide -sensitive, 1A
  Uniprot ID: P54105
  ENSP ID: ENSP00000434311

SEQ ID NO: 14887 - protein, 167 aa, Homo sapiens
  Payload ID: 2908
  Gene Symbol: CLNS1A
  Gene Name: chloride channel, nucleotide -sensitive, 1A
  ENSP ID: ENSP00000434963
MSFLKSFPPPGPAEGLLRQQPDTEAVLNGKGLGTGTLYIAESRLSWLDGSGLGFSLEYPTISLHALSRDRSDCLGEHLYVMVNAKFEEQGQGDIPTFYTYEEGLSHLTAEGQATLERLEGMLSQSVSSQYNMAGVRTEDSIRDYEDGMEVDTTPTVAGQFEDADVDH

SEQ ID NO: 14888 - protein, 23 aa, Homo sapiens
  Payload ID: 2908
  Gene Symbol: CLNS1A
  Gene Name: chloride channel, nucleotide -sensitive, 1A
  ENSP ID: ENSP00000436245
  MOD_RES (1)..(1): Any amino acid
XRTEDSIRDYEGIHTPTKARERF

SEQ ID NO: 14889 - protein, 22 aa, Homo sapiens
  Payload ID: 2908
  Gene Symbol: CLNS1A
  Gene Name: chloride channel, nucleotide -sensitive, 1A
  ENSP ID: ENSP00000475218
  MOD_RES (1)..(1): Any amino acid
XGMEVDTTPTVAGQFEDADVDH

SEQ ID NO: 14890 - protein, 988 aa, Homo sapiens
  Payload ID: 2909
  Gene Symbol: CLCN1
  Gene Name: chloride channel, voltage-sensitive 1
  Uniprot ID: P35523
  ENSP ID: ENSP00000339867
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDGIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGLPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 14891 - protein, 76 aa, Homo sapiens
  Payload ID: 2909
  Gene Symbol: CLCN1
  Gene Name: chloride channel, voltage-sensitive 1
  ENSP ID: ENSP00000395949
  MOD_RES (1)..(1): Any amino acid
XISPQAVGSGIPEMKTILRGVVLKEYLTMKAFVAKVVALTAGLGSGIPVGKEPVPVLQMSTPLSPVAPHGDRAWAA

SEQ ID NO: 14892 - protein, 102 aa, Homo sapiens
  Payload ID: 2909
  Gene Symbol: CLCN1
  Gene Name: chloride channel, voltage-sensitive 1
  ENSP ID: ENSP00000400027
  MOD_RES (1)..(1): Any amino acid
XISPQAVGSGIPEMKTILRGVVLKEYLTMKAFVAKVVALTAGLGSGIPVGKEGPFVHIASICAAVLSKFMSVFCGVYEPVPVLQMSTPLSPVAPHGDRAWAA

SEQ ID NO: 14893 - protein, 898 aa, Homo sapiens
  Payload ID: 2910
  Gene Symbol: CLCN2
  Gene Name: chloride channel, voltage-sensitive 2
  Uniprot ID: P51788
  ENSP ID: ENSP00000265593
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 14894 - protein, 881 aa, Homo sapiens
  Payload ID: 2910
  Gene Symbol: CLCN2
  Gene Name: chloride channel, voltage-sensitive 2
  Uniprot ID: P51788
  ENSP ID: ENSP00000345056
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 14895 - protein, 869 aa, Homo sapiens
  Payload ID: 2910
  Gene Symbol: CLCN2
  Gene Name: chloride channel, voltage-sensitive 2
  Uniprot ID: P51788
  ENSP ID: ENSP00000391928
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKLRKAIEGSVTAQGVKVRPPLASFRDSATSSSDTETTEVHALWGPHSRHGLPREGSPSDSDDKCQ

SEQ ID NO: 14896 - protein, 133 aa, Homo sapiens
  Payload ID: 2910
  Gene Symbol: CLCN2
  Gene Name: chloride channel, voltage-sensitive 2
  ENSP ID: ENSP00000396231
  MOD_RES (1)..(1): Any amino acid
XTINRFLMRKRLLFPALVTLLISTLTFPPGFGQFMAGQLSQKETLVTLFDNRTWVRQGLVEELEPPSTSQAWNPPRANVFLTLVIFILMKHLGVWWVKAWLPGSQMEFIRTAAPTGLCLGATLWSGQLRWQER

SEQ ID NO: 14897 - protein, 854 aa, Homo sapiens
  Payload ID: 2910
  Gene Symbol: CLCN2
  Gene Name: chloride channel, voltage-sensitive 2
  Uniprot ID: P51788
  ENSP ID: ENSP00000400425
MAAAAAEEGMEPRALQYEQTLMYGRYTQDLGAFAKEEAARIRLGGPEPWKGPPSSRAAPELLEYGRSRCARCRAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 14898 - protein, 866 aa, Homo sapiens
  Payload ID: 2911
  Gene Symbol: CLCN3
  Gene Name: chloride channel, voltage-sensitive 3
  Uniprot ID: P51790
  ENSP ID: ENSP00000261514
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGIVLGIITKKNILEHLEQLKQHVEPLAPPWHYNKKRYPPAYGPDGKPRPRFNNVQLNLTDEEREETEEEVYLLNSTTL

SEQ ID NO: 14899 - protein, 791 aa, Homo sapiens
  Payload ID: 2911
  Gene Symbol: CLCN3
  Gene Name: chloride channel, voltage-sensitive 3
  Uniprot ID: P51790
  ENSP ID: ENSP00000353857
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 14900 - protein, 245 aa, Homo sapiens
  Payload ID: 2911
  Gene Symbol: CLCN3
  Gene Name: chloride channel, voltage-sensitive 3
  ENSP ID: ENSP00000422678
  MOD_RES (1)..(1): Any amino acid
XAGVSVAFGAPIGGVLFSLEEVSYYFPLKTLWRSFFAALVAAFVLRSINPFGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMT

SEQ ID NO: 14901 - protein, 801 aa, Homo sapiens [sequence omitted]

SEQ ID NO: 14902 - protein, 818 aa, Homo sapiens
  Payload ID: 2911
  Gene Symbol: CLCN3
  Gene Name: chloride channel, voltage-sensitive 3
  Uniprot ID: P51790
  ENSP ID: ENSP00000424603
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 14903 - protein, 173 aa, Homo sapiens
  Payload ID: 2911
  Gene Symbol: CLCN3
  Gene Name: chloride channel, voltage-sensitive 3
  ENSP ID: ENSP00000425160
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCC

SEQ ID NO: 14904 - protein, 725 aa, Homo sapiens
  Payload ID: 2911
  Gene Symbol: CLCN3
  Gene Name: chloride channel, voltage-sensitive 3
  ENSP ID: ENSP00000425323
MDASSDPYLPYDGGGDSIPLRELHKRGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLR

SEQ ID NO: 14905 - protein, 138 aa, Homo sapiens
  Payload ID: 2911
  Gene Symbol: CLCN3
  Gene Name: chloride channel, voltage-sensitive 3
  ENSP ID: ENSP00000425823
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLA

SEQ ID NO: 14906 - protein, 791 aa, Homo sapiens
  Payload ID: 2911
  Gene Symbol: CLCN3
  Gene Name: chloride channel, voltage-sensitive 3
  ENSP ID: ENSP00000478336
MDASSDPYLPYDGGGDSIPLRELHKRGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 14907 - protein, 729 aa, Homo sapiens
  Payload ID: 2912
  Gene Symbol: CLCN4
  Gene Name: chloride channel, voltage-sensitive 4
  ENSP ID: ENSP00000370209
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 14908 - protein, 760 aa, Homo sapiens
  Payload ID: 2912
  Gene Symbol: CLCN4
  Gene Name: chloride channel, voltage-sensitive 4
  Uniprot ID: P51793
  ENSP ID: ENSP00000370213
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 14909 - protein, 152 aa, Homo sapiens
  Payload ID: 2912
  Gene Symbol: CLCN4
  Gene Name: chloride channel, voltage-sensitive 4
  ENSP ID: ENSP00000403064
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEVLSAAAAA

SEQ ID NO: 14910 - protein, 666 aa, Homo sapiens
  Payload ID: 2912
  Gene Symbol: CLCN4
  Gene Name: chloride channel, voltage-sensitive 4
  Uniprot ID: P51793
  ENSP ID: ENSP00000405754
MTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 14911 - protein, 746 aa, Homo sapiens
  Payload ID: 2913
  Gene Symbol: CLCN5
  Gene Name: chloride channel, voltage-sensitive 5
  Uniprot ID: P51795
  ENSP ID: ENSP00000304257
MDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 14912 - protein, 816 aa, Homo sapiens
  Payload ID: 2913
  Gene Symbol: CLCN5
  Gene Name: chloride channel, voltage-sensitive 5
  Uniprot ID: P51795
  ENSP ID: ENSP00000365256
MAMWQGAMDNRGFQQGSFSSFQNSSSDEDLMDIPATAMDFSMRDDVPPLDREVGEDKSYNGGGIGSSNRIMDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 14913 - protein, 816 aa, Homo sapiens; identical to SEQ ID NO: 14912
  Payload ID: 2913
  Gene Symbol: CLCN5
  Gene Name: chloride channel, voltage-sensitive 5
  Uniprot ID: P51795
  ENSP ID: ENSP00000365259

SEQ ID NO: 14914 - protein, 746 aa, Homo sapiens; identical to SEQ ID NO: 14911
  Payload ID: 2913
  Gene Symbol: CLCN5
  Gene Name: chloride channel, voltage-sensitive 5
  Uniprot ID: P51795
  ENSP ID: ENSP00000365276

SEQ ID NO: 14915 - protein, 64 aa, Homo sapiens
  Payload ID: 2913
  Gene Symbol: CLCN5
  Gene Name: chloride channel, voltage-sensitive 5
  ENSP ID: ENSP00000476732
MAMWQGAMDNRGFQQGSFSSFQNSSSDEDLMDIPATAMDFSMRDDVPPLDREVGGIIIGDDNLS

SEQ ID NO: 14916 - protein, 869 aa, Homo sapiens
  Payload ID: 2914
  Gene Symbol: CLCN6
  Gene Name: chloride channel, voltage-sensitive 6
  Uniprot ID: P51797
  ENSP ID: ENSP00000234488
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 14917 - protein, 847 aa, Homo sapiens
  Payload ID: 2914
  Gene Symbol: CLCN6
  Gene Name: chloride channel, voltage-sensitive 6
  Uniprot ID: P51797
  ENSP ID: ENSP00000308367
MAGCRGSLCCCCRWCCCCGERETRTPEELTILGETQEEEDEILPRKDYEKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 14918 - protein, 953 aa, Homo sapiens
  Payload ID: 2914
  Gene Symbol: CLCN6
  Gene Name: chloride channel, voltage-sensitive 6
  Uniprot ID: P51797
  ENSP ID: ENSP00000365679
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEVSEAPALPPPLREDPLARCCLCTQASHQKRRHPTRRGECGPTLALNPARLPCTRDPFPCLPADGTSVPLAVLSSQSRASTRLCLPPEMLLFTPYHWCSLVLHLRRDLRIR

SEQ ID NO: 14919 - protein, 122 aa, Homo sapiens
  Payload ID: 2914
  Gene Symbol: CLCN6
  Gene Name: chloride channel, voltage-sensitive 6
  ENSP ID: ENSP00000365680
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTYKFQMKM

SEQ ID NO: 14920 - protein, 901 aa, Homo sapiens
  Payload ID: 2915
  Gene Symbol: CLCN7
  Gene Name: chloride channel, voltage-sensitive 7
  ENSP ID: ENSP00000262318
MANVSKKVSWSGRDRDDEEAAPLLRRTARPGGGTPLLNGAGPGAARQDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQACVAPTGVQAVPGPGPAAPGGGGQPQSGCRVGDQEGPRQVPPGKERLGGALAGPDVRPSPAHNGHWRWHPGPSAFPPGVTGFSAQTMLPSSGNGEHPAAGRAGGRRGTDPLAGLTLLWAVVSPLGASLRRPSLHSPRLGFFTSRDQLCVCDLPTGLSASWEPAAGPAPACLCPCA

SEQ ID NO: 14921 - protein, 805 aa, Homo sapiens
  Payload ID: 2915
  Gene Symbol: CLCN7
  Gene Name: chloride channel, voltage-sensitive 7
  Uniprot ID: P51798
  ENSP ID: ENSP00000372193
MANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 14922 - protein, 781 aa, Homo sapiens
  Payload ID: 2915
  Gene Symbol: CLCN7
  Gene Name: chloride channel, voltage-sensitive 7
  Uniprot ID: P51798
  ENSP ID: ENSP00000410907
MANVSKKVSWSGRDRDDEEAAPLLRRTARPGGGTPLLNGAGPGAARQDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 14923 - protein, 118 aa, Homo sapiens
  Payload ID: 2915
  Gene Symbol: CLCN7
  Gene Name: chloride channel, voltage-sensitive 7
  ENSP ID: ENSP00000454845
MSPCSVRLSSVKSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAG

SEQ ID NO: 14924 - protein, 216 aa, Homo sapiens
  Payload ID: 2915
  Gene Symbol: CLCN7
  Gene Name: chloride channel, voltage-sensitive 7
  ENSP ID: ENSP00000461009
MSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFK

SEQ ID NO: 14925 - protein, 687 aa, Homo sapiens
  Payload ID: 2916
  Gene Symbol: CLCNKA
  Gene Name: chloride channel, voltage-sensitive Ka
  Uniprot ID: P51800
  ENSP ID: ENSP00000332771
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 14926 - protein, 686 aa, Homo sapiens
  Payload ID: 2916
  Gene Symbol: CLCNKA
  Gene Name: chloride channel, voltage-sensitive Ka
  Uniprot ID: P51800
  ENSP ID: ENSP00000364844
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQCLQDILARGCPTEPVTLTLFSETTLHQAQNLFKLLNLQSLFVTSRGRAVGCVSWVEMKKAISNLTNPPAPK

SEQ ID NO: 14927 - protein, 644 aa, Homo sapiens
  Payload ID: 2916
  Gene Symbol: CLCNKA
  Gene Name: chloride channel, voltage-sensitive Ka
  Uniprot ID: P51800
  ENSP ID: ENSP00000414445
MEELVGLREGFSGDPVTLQELWGPCPHIRRAIQGGLEWLKQKVFRLGEDWYFLMTLGVLMALVSYAMNFAIGCVVRGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 14928 - protein, 517 aa, Homo sapiens
  Payload ID: 2917
  Gene Symbol: CLCNKB
  Gene Name: chloride channel, voltage-sensitive Kb
  Uniprot ID: P51801
  ENSP ID: ENSP00000364819
MPCPPLLSVPVRAAGEQDRWVREEVTWGGGPTVTGGWGWRAHLRSVSPPGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQCLQDILAAGCPTEPVTLKLSPETSLHEAHNLFELLNLHSLFVTSRGRAVGCVSWVEMKKAISNLTNPPAPK

SEQ ID NO: 14929 - protein, 687 aa, Homo sapiens
  Payload ID: 2917
  Gene Symbol: CLCNKB
  Gene Name: chloride channel, voltage-sensitive Kb
  Uniprot ID: P51801
  ENSP ID: ENSP00000364831
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFAAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 14930 - protein, 146 aa, Homo sapiens
  Payload ID: 2917
  Gene Symbol: CLCNKB
  Gene Name: chloride channel, voltage-sensitive Kb
  ENSP ID: ENSP00000389344
AQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQCLQDILAAGCPTEPVTLKLSPETSLHEAQMPSGVVWFPVRGS

SEQ ID NO: 14931 - protein, 463 aa, Homo sapiens
  Payload ID: 2917
  Gene Symbol: CLCNKB
  Gene Name: chloride channel, voltage-sensitive Kb
  ENSP ID: ENSP00000483866
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSNKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAITLMNDEIGVHCHQGQAQMPSGVVWFPVRGS

SEQ ID NO: 14932 - protein, 241 aa, Homo sapiens
  Payload ID: 2918
  Gene Symbol: CLIC1
  Gene Name: chloride intracellular channel 1
  Uniprot ID: O00299
  ENSP ID: ENSP00000364934
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 14933 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000364935

SEQ ID NO: 14934 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000364940

SEQ ID NO: 14935 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000372896

SEQ ID NO: 14936 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000372897

SEQ ID NO: 14937 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000379229

SEQ ID NO: 14938 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000382926

SEQ ID NO: 14939 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000382931

SEQ ID NO: 14940 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000391395

SEQ ID NO: 14941 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000398056

SEQ ID NO: 14942 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000400280

SEQ ID NO: 14943 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000400532

SEQ ID NO: 14944 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000401292

SEQ ID NO: 14945 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000404037

SEQ ID NO: 14946 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000404589

SEQ ID NO: 14947 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000406088

SEQ ID NO: 14948 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000406335

SEQ ID NO: 14949 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000406968

SEQ ID NO: 14950 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000407429

SEQ ID NO: 14951 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000407791

SEQ ID NO: 14952 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000408094

SEQ ID NO: 14953 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000408357

SEQ ID NO: 14954 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000409247

SEQ ID NO: 14955 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000409979

SEQ ID NO: 14956 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000410965

SEQ ID NO: 14957 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000412217

SEQ ID NO: 14958 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000413330

SEQ ID NO: 14959 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000416211

SEQ ID NO: 14960 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000477623

SEQ ID NO: 14961 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000478930

SEQ ID NO: 14962 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000479501

SEQ ID NO: 14963 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000479808

SEQ ID NO: 14964 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000480256

SEQ ID NO: 14965 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000482255

SEQ ID NO: 14966 - protein, 241 aa, Homo sapiens; identical to SEQ ID NO: 14932
  Payload ID: 2918
  Gene Symbol: CLIC1
  Gene Name: chloride intracellular channel 1
  Uniprot ID: O00299
  ENSP ID: ENSP00000484581

SEQ ID NO: 14967 - protein, 133 aa, Homo sapiens
  Payload ID: 2919
  Gene Symbol: CLIC2
  Gene Name: chloride intracellular channel 2
  ENSP ID: ENSP00000318558
MSGLRPGTQVDPEIELFVKAGSDGESIGNCPFCQRLFMILWLKGVKFNVTTVDMTRYPHLSPKYKESFDVGCNLFAKFSAYIKNTQKEANKNFEKSLLKEFKRLDDYLNTPLLDEIDPDSAEEPPVSRRLFLD

SEQ ID NO: 14968 - protein, 247 aa, Homo sapiens
  Payload ID: 2919
  Gene Symbol: CLIC2
  Gene Name: chloride intracellular channel 2
  Uniprot ID: O15247
  ENSP ID: ENSP00000358460
MSGLRPGTQVDPEIELFVKAGSDGESIGNCPFCQRLFMILWLKGVKFNVTTVDMTRKPEELKDLAPGTNPPFLVYNKELKTDFIKIEEFLEQTLAPPRYPHLSPKYKESFDVGCNLFAKFSAYIKNTQKEANKNFEKSLLKEFKRLDDYLNTPLLDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 14969 - protein, 236 aa, Homo sapiens
  Payload ID: 2920
  Gene Symbol: CLIC3
  Gene Name: chloride intracellular channel 3
  Uniprot ID: O95833
  ENSP ID: ENSP00000419378
MAETKLQLFVKASEDGESVGHCPSCQRLFMVLLLKGVPFTLTTVDTRRSPDVLKDFAPGSQLPILLYDSDAKTDTLQIEDFLEETLGPPDFPSLAPRYRESNTAGNDVFHKFSAFIKNPVPAQDEALYQQLLRALARLDSYLRAPLEHELAGEPQLRESRRRFLDGDRLTLADCSLLPKLHIVDTVCAHFRQAPIPAELRGVRRYLDSAMQEKEFKYTCPHSAEILAAYRPAVHPR

SEQ ID NO: 14970 - protein, 253 aa, Homo sapiens
  Payload ID: 2921
  Gene Symbol: CLIC4
  Gene Name: chloride intracellular channel 4
  Uniprot ID: Q9Y696
  ENSP ID: ENSP00000363500
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 14971 - protein, 253 aa, Homo sapiens; identical to SEQ ID NO: 14970
  Payload ID: 2921
  Gene Symbol: CLIC4
  Gene Name: chloride intracellular channel 4
  Uniprot ID: Q9Y696
  ENSP ID: ENSP00000436538

SEQ ID NO: 14972 - protein, 410 aa, Homo sapiens
  Payload ID: 2922
  Gene Symbol: CLIC5
  Gene Name: chloride intracellular channel 5
  Uniprot ID: Q9NZA1
  ENSP ID: ENSP00000185206
MNDEDYSTIYDTIQNERTYEVPDQPEENESPHYDDVHEYLRPENDLYATQLNTHEYDFVSVYTIKGEETSLASVQSEDRGYLLPDEIYSELQEAHPGEPQEDRGISMEGLYSSTQDQQLCAAELQENGSVMKEDLPSPSSFTIQHSKAFSTTKYSCYSDAEGLEEKEGAHMNPEIYLFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 14973 - protein, 251 aa, Homo sapiens
  Payload ID: 2922
  Gene Symbol: CLIC5
  Gene Name: chloride intracellular channel 5
  Uniprot ID: Q9NZA1
  ENSP ID: ENSP00000344165
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 14974 - protein, 205 aa, Homo sapiens
  Payload ID: 2922
  Gene Symbol: CLIC5
  Gene Name: chloride intracellular channel 5
  Uniprot ID: Q9NZA1
  ENSP ID: ENSP00000439195
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKEQVPLKGMI

SEQ ID NO: 14975 - protein, 686 aa, Homo sapiens
  Payload ID: 2923
  Gene Symbol: CLIC6
  Gene Name: chloride intracellular channel 6
  Uniprot ID: Q96NY7
  ENSP ID: ENSP00000290332
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 14976 - protein, 704 aa, Homo sapiens
  Payload ID: 2923
  Gene Symbol: CLIC6
  Gene Name: chloride intracellular channel 6
  Uniprot ID: Q96NY7
  ENSP ID: ENSP00000353959
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKVKLTALGCSRIAIKKYLRAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 14977 - protein, 115 aa, Homo sapiens
  Payload ID: 2924
  Gene Symbol: CCK
  Gene Name: cholecystokinin
  Uniprot ID: P06307
  ENSP ID: ENSP00000335657
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 14978 - protein, 115 aa, Homo sapiens; identical to SEQ ID NO: 14977
  Payload ID: 2924
  Gene Symbol: CCK
  Gene Name: cholecystokinin
  Uniprot ID: P06307
  ENSP ID: ENSP00000379472

SEQ ID NO: 14979 - protein, 115 aa, Homo sapiens; identical to SEQ ID NO: 14977
  Payload ID: 2924
  Gene Symbol: CCK
  Gene Name: cholecystokinin
  Uniprot ID: P06307
  ENSP ID: ENSP00000409124

SEQ ID NO: 14980 - protein, 428 aa, Homo sapiens
  Payload ID: 2925
  Gene Symbol: CCKAR
  Gene Name: cholecystokinin A receptor
  Uniprot ID: P32238
  ENSP ID: ENSP00000295589
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 14981 - protein, 447 aa, Homo sapiens
  Payload ID: 2926
  Gene Symbol: CCKBR
  Gene Name: cholecystokinin B receptor
  Uniprot ID: P32239
  ENSP ID: ENSP00000335544
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 14982 - protein, 363 aa, Homo sapiens
  Payload ID: 2926
  Gene Symbol: CCKBR
  Gene Name: cholecystokinin B receptor
  ENSP ID: ENSP00000432079
MELLKLNRSVQGTGPGPGASLCRPGAPLLNSSSVGNLSCEPPRIRGAGTRGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 14983 - protein, 516 aa, Homo sapiens
  Payload ID: 2926
  Gene Symbol: CCKBR
  Gene Name: cholecystokinin B receptor
  Uniprot ID: P32239
  ENSP ID: ENSP00000435534
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGGAGPREQNLGEAELWRATGPAGVGGTEMKVRVRRKLEMELSWERRSGGDWAGDWGDSPFSLTAHPLCSGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 14984 - protein, 87 aa, Homo sapiens
  Payload ID: 2926
  Gene Symbol: CCKBR
  Gene Name: cholecystokinin B receptor
  ENSP ID: ENSP00000435675
MELLKLNRSVQGTGPGPGASLCRPGAPLLNSSSVGNLSCEPPRIRGAGTRDRTNTDLLNTRRRTELSQSSESPGLMPVFLIPRKMMR

SEQ ID NO: 14985 - protein, 136 aa, Homo sapiens
  Payload ID: 2926
  Gene Symbol: CCKBR
  Gene Name: cholecystokinin B receptor
  ENSP ID: ENSP00000437001
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGG

SEQ ID NO: 14986 - protein, 272 aa, Homo sapiens
  Payload ID: 2927
  Gene Symbol: CH25H
  Gene Name: cholesterol 25-hydroxylase
  Uniprot ID: O95992
  ENSP ID: ENSP00000360918
MSCHNCSDPQVLCSSGQLFLQPLWDHLRSWEALLQSPFFPVIFSITTYVGFCLPFVVLDILCSWVPALRRYKIHPDFSPSAQQLLPCLGQTLYQHVMFVFPVTLLHWARSPALLPHEAPELLLLLHHILFCLLLFDMEFFVWHLLHHKVPWLYRTFHKVHHQNSSSFALATQYMSVWELFSLGFFDMMNVTLLGCHPLTTLTFHVVNIWLSVEDHSGYNFPWSTHRLVPFGWYGGVVHHDLHHSHFNCNFAPYFTHWDKILGTLRTASVPAR

SEQ ID NO: 14987 - protein, 493 aa, Homo sapiens [sequence omitted]

SEQ ID NO: 14988 - protein, 433 aa, Homo sapiens
  Payload ID: 2928
  Gene Symbol: CETP
  Gene Name: cholesteryl ester transfer protein, plasma
  Uniprot ID: P11597
  ENSP ID: ENSP00000369106
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 14989 - protein, 428 aa, Homo sapiens
  Payload ID: 2928
  Gene Symbol: CETP
  Gene Name: cholesteryl ester transfer protein, plasma
  ENSP ID: ENSP00000456276
MMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKGHFIYKNVSEDLPLPTFSPTLLGDSRMLYFWFSERVFHSLAKVAFQDGRLMLSLMGDEFKAVLETWGFNTNQEIFQEVVGGFPSQAQVTVHCLKMPKISCQNKGVVVNSSVMVKFLFPRPDQQHSVAYTFEEDIVTTVQASYSKKKLFLSLLDFQITPKTVSNLTESSSESVQSFLQSMITAVGIPEVMSRLEVVFTALMNSKGVSLFDIINPEIITRDGFLLLQMDFGFPEHLLVDFLQSLS

SEQ ID NO: 14990 - protein, 594 aa, Homo sapiens
  Payload ID: 2929
  Gene Symbol: CHDH
  Gene Name: choline dehydrogenase
  Uniprot ID: Q8NE62
  ENSP ID: ENSP00000319851
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVIQPNYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 14991 - protein, 155 aa, Homo sapiens
  Payload ID: 2929
  Gene Symbol: CHDH
  Gene Name: choline dehydrogenase
  ENSP ID: ENSP00000418273
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGRVWGGSSSLNAMVYVRGHAEDYERWQRQGA

SEQ ID NO: 14992 - protein, 126 aa, Homo sapiens
  Payload ID: 2929
  Gene Symbol: CHDH
  Gene Name: choline dehydrogenase
  ENSP ID: ENSP00000419863
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGR

SEQ ID NO: 14993 - protein, 457 aa, Homo sapiens
  Payload ID: 2930
  Gene Symbol: CHKA
  Gene Name: choline kinase alpha
  Uniprot ID: P35790
  ENSP ID: ENSP00000265689
MKTKFCTGGEAEPSPLGLLLSCGSGSAAPAPGVGQQRDAASDLESKQLGGQQPPLALPPPPPLPLPLPLPQPPPPQPPADEQPEPRTRRRAYLWCKEFLPGAWRGLREDEFHISVIRGGLSNMLFQCSLPDTTATLGDEPRKVLLRLYGAILQMRSCNKEGSEQAQKENEFQGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 14994 - protein, 439 aa, Homo sapiens
  Payload ID: 2930
  Gene Symbol: CHKA
  Gene Name: choline kinase alpha
  Uniprot ID: P35790
  ENSP ID: ENSP00000348454
MKTKFCTGGEAEPSPLGLLLSCGSGSAAPAPGVGQQRDAASDLESKQLGGQQPPLALPPPPPLPLPLPLPQPPPPQPPADEQPEPRTRRRAYLWCKEFLPGAWRGLREDEFHISVIRGGLSNMLFQCSLPDTTATLGDEPRKVLLRLYGAILQMGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLLSYNLPLELENLRSLLESTPSPVVFCHNDCQEGNILLLEGRENSEKQKLMLIDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMDYAQARFDAYFHQKRKLGV

SEQ ID NO: 14995 - protein, 164 aa, Homo sapiens
  Payload ID: 2930
  Gene Symbol: CHKA
  Gene Name: choline kinase alpha
  ENSP ID: ENSP00000432631
IDFEYSSYNYRGFDIGNHFCEWMYDYSYEKYPFFRANIRKYPTKKQQLHFISSYLPAFQNDFENLSTEEKSIIKEEMLLEVNRFALASHFLWGLWSIVQAKISSIEFGYMYPNVVTWWHQDSVAQPRKPGEKPLSLMLWLPLEVALTSRPADLASPASEKCLQS

SEQ ID NO: 14996 - protein, 156 aa, Homo sapiens
  Payload ID: 2930
  Gene Symbol: CHKA
  Gene Name: choline kinase alpha
  ENSP ID: ENSP00000435032
MLFQCSLPDTTATLGDEPRKVLLRLYGAILQMRSCNKEGSEQAQKENEFQGAEAMVLESVMFAILAERSLGPKLYGIFPQGRLEQFIPSRRLDTEELSLPDISAEIAEKMATFHGMKMPFNKEPKWLFGTMEKYLKEVLRIKFTEESRIKKLHKLL

SEQ ID NO: 14997 - protein, 395 aa, Homo sapiens
  Payload ID: 2931
  Gene Symbol: CHKB
  Gene Name: choline kinase beta
  Uniprot ID: Q9Y259
  ENSP ID: ENSP00000384400
MAAEATAVAGSGAVGGCLAKDGLQQSKCPDTTPKRRRASSLSRDAERRAYQWCREYLGGAWRRVQPEELRVYPVSGGLSNLLFRCSLPDHLPSVGEEPREVLLRLYGAILQGVDSLVLESVMFAILAERSLGPQLYGVFPEGRLEQYIPSRPLKTQELREPVLSAAIATKMAQFHGMEMPFTKEPHWLFGTMERYLKQIQDLPPTGLPEMNLLEMYSLKDEMGNLRKLLESTPSPVVFCHNDIQEGNILLLSEPENADSLMLVDFEYSSYNYRGFDIGNHFCEWVYDYTHEEWPFYKARPTDYPTQEQQLHFIRHYLAEAKKGETLSQEEQRKLEEDLLVEVSRYALASHFFWGLWSILQASMSTIEFGYLDYAQSRFQFYFQQKGQLTSVHSSS

SEQ ID NO: 14998 - protein, 748 aa, Homo sapiens
  Payload ID: 2932
  Gene Symbol: CHAT
  Gene Name: choline O-acetyltransferase
  Uniprot ID: P28329
  ENSP ID: ENSP00000337103
MGLRTAKKRGLGGGGKWKREEGGGTRGRREVRPACFLQSGGRGDPGDVGGPAGNPGCSPHPRAATRPPPLPAHTPAHTPEWCGAASAEAAEPRRAGPHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 14999 - protein, 630 aa, Homo sapiens
  Payload ID: 2932
  Gene Symbol: CHAT
  Gene Name: choline O-acetyltransferase
  Uniprot ID: P28329
  ENSP ID: ENSP00000343486
MAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 15000 - protein, 630 aa, Homo sapiens; identical to SEQ ID NO: 14999
  Payload ID: 2932
  Gene Symbol: CHAT
  Gene Name: choline O-acetyltransferase
  Uniprot ID: P28329
  ENSP ID: ENSP00000345878

SEQ ID NO: 15001 - protein, 630 aa, Homo sapiens; identical to SEQ ID NO: 14999
  Payload ID: 2932
  Gene Symbol: CHAT
  Gene Name: choline O-acetyltransferase
  Uniprot ID: P28329
  ENSP ID: ENSP00000378926

SEQ ID NO: 15002 - protein, 666 aa, Homo sapiens
  Payload ID: 2932
  Gene Symbol: CHAT
  Gene Name: choline O-acetyltransferase
  Uniprot ID: P28329
  ENSP ID: ENSP00000378929
MWPECRDEALSTVGPHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHVTQSSRKLIRADSVSELPAPRRLRWKCSPEIQGHLASSAEKLQRIVKNLDFIVYKFDNYGKTFIKKQKCSPDAFIQVALQLAFYRLHRRLVPTYESASIRRFQEGRVDNIRSATPEALAFVRAVTDHKAAVPASEKLLLLKDAIRAQTAYTVMAITGMAIDNHLLALRELARAMCKELPEMFMDETYLMSNRFVLSTSQVPTTTEMFCCYGPVVPNGYGACYNPQPETILFCISSFHSCKETSSSKFAKAVEESLIDMRDLCSLLPPTESKPLATKEKATRPSQGHQP

SEQ ID NO: 15003 - protein, 112 aa, Homo sapiens
  Payload ID: 2932
  Gene Symbol: CHAT
  Gene Name: choline O-acetyltransferase
  ENSP ID: ENSP00000473443
MGLRTAKKRGLGGGGKWKREEGGGTRGRREVRPACFLQSGGRGDPGDVGGPAGNPGCSPHPRAATRPPPLPAHTPAHTPEWCGAASAEAAEPRRAVREFTLLHTRDVAGMQR

SEQ ID NO: 15004 - protein, 406 aa, Homo sapiens
  Payload ID: 2933
  Gene Symbol: CHPT1
  Gene Name: choline phosphotransferase 1
  Uniprot ID: Q8WUD6
  ENSP ID: ENSP00000229266
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 15005 - protein, 398 aa, Homo sapiens
  Payload ID: 2933
  Gene Symbol: CHPT1
  Gene Name: choline phosphotransferase 1
  ENSP ID: ENSP00000446994
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVHKHID

SEQ ID NO: 15006 - protein, 218 aa, Homo sapiens
  Payload ID: 2933
  Gene Symbol: CHPT1
  Gene Name: choline phosphotransferase 1
  Uniprot ID: Q8WUD6
  ENSP ID: ENSP00000447887
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTFS

SEQ ID NO: 15007 - protein, 94 aa, Homo sapiens
  Payload ID: 2933
  Gene Symbol: CHPT1
  Gene Name: choline phosphotransferase 1
  ENSP ID: ENSP00000447920
  MOD_RES (1)..(1): Any amino acid
XAARLGTYPDWFFFCSFIGMFVFYCAHWQTYVSGMLRFGKVDVTEIQIALVIVFVLSAFGGATMWDYTVKIPILRNVFIFCLLGDLSSFIKVGS

SEQ ID NO: 15008 - protein, 38 aa, Homo sapiens
  Payload ID: 2933
  Gene Symbol: CHPT1
  Gene Name: choline phosphotransferase 1
  ENSP ID: ENSP00000448369
  MOD_RES (1)..(1): Any amino acid
XFSALCLQISRHLHLNIFKTACHQAPEQGLAVAQAGVQ

SEQ ID NO: 15009 - protein, 398 aa, Homo sapiens; identical to SEQ ID NO: 15005
  Payload ID: 2933
  Gene Symbol: CHPT1
  Gene Name: choline phosphotransferase 1
  ENSP ID: ENSP00000448766

SEQ ID NO: 15010 - protein, 184 aa, Homo sapiens
  Payload ID: 2933
  Gene Symbol: CHPT1
  Gene Name: choline phosphotransferase 1
  ENSP ID: ENSP00000448831
  MOD_RES (1)..(1): Any amino acid
XAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTFS

SEQ ID NO: 15011 - protein, 416 aa, Homo sapiens
  Payload ID: 2934
  Gene Symbol: CEPT1
  Gene Name: choline/ethanolamine phosphotransferase 1
  Uniprot ID: Q9Y6K0
  ENSP ID: ENSP00000349696
MSGHRSTRKRCGDSHPESPVGFGHMSTTGCVLNKLFQLPTPPLSRHQLKRLEEHRYQSAGRSLLEPLMQGYWEWLVRRVPSWIAPNLITIIGLSINICTTILLVFYCPTATEQAPLWAYIACACGLFIYQSLDAIDGKQARRTNSSSPLGELFDHGCDSLSTVFVVLGTCIAVQLGTNPDWMFFCCFAGTFMFYCAHWQTYVSGTLRFGIIDVTEVQIFIIIMHLLAVIGGPPFWQSMIPVLNIQMKIFPALCTVAGTIFSCTNYFRVIFTGGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 15012 - protein, 416 aa, Homo sapiens; identical to SEQ ID NO: 15011
  Payload ID: 2934
  Gene Symbol: CEPT1
  Gene Name: choline/ethanolamine phosphotransferase 1
  Uniprot ID: Q9Y6K0
  ENSP ID: ENSP00000441980

SEQ ID NO: 15013 - protein, 280 aa, Homo sapiens [sequence omitted]

SEQ ID NO: 15014 - protein, 460 aa, Homo sapiens
  Payload ID: 2935
  Gene Symbol: CHRM1
  Gene Name: cholinergic receptor, muscarinic 1
  Uniprot ID: P11229
  ENSP ID: ENSP00000306490
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 15015 - protein, 454 aa, Homo sapiens
  Payload ID: 2935
  Gene Symbol: CHRM1
  Gene Name: cholinergic receptor, muscarinic 1
  Uniprot ID: P11229
  ENSP ID: ENSP00000441188
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHR

SEQ ID NO: 15016 - protein, 134 aa, Homo sapiens
  Payload ID: 2935
  Gene Symbol: CHRM1
  Gene Name: cholinergic receptor, muscarinic 1
  ENSP ID: ENSP00000444482
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYR

SEQ ID NO: 15017 - protein, 466 aa, Homo sapiens
  Payload ID: 2936
  Gene Symbol: CHRM2
  Gene Name: cholinergic receptor, muscarinic 2
  Uniprot ID: P08172
  ENSP ID: ENSP00000319984
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 15018 - protein, 466 aa, Homo sapiens; identical to SEQ ID NO: 15017
  Payload ID: 2936
  Gene Symbol: CHRM2
  Gene Name: cholinergic receptor, muscarinic 2
  Uniprot ID: P08172
  ENSP ID: ENSP00000384401

SEQ ID NO: 15019 - protein, 466 aa, Homo sapiens; identical to SEQ ID NO: 15017
  Payload ID: 2936
  Gene Symbol: CHRM2
  Gene Name: cholinergic receptor, muscarinic 2
  Uniprot ID: P08172
  ENSP ID: ENSP00000399745

SEQ ID NO: 15020 - protein, 466 aa, Homo sapiens; identical to SEQ ID NO: 15017
  Payload ID: 2936
  Gene Symbol: CHRM2
  Gene Name: cholinergic receptor, muscarinic 2
  Uniprot ID: P08172
  ENSP ID: ENSP00000415386

SEQ ID NO: 15021 - protein, 590 aa, Homo sapiens
  Payload ID: 2937
  Gene Symbol: CHRM3
  Gene Name: cholinergic receptor, muscarinic 3
  Uniprot ID: P20309
  ENSP ID: ENSP00000255380
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 15022 - protein, 109 aa, Homo sapiens
  Payload ID: 2937
  Gene Symbol: CHRM3
  Gene Name: cholinergic receptor, muscarinic 3
  ENSP ID: ENSP00000404764
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLS

SEQ ID NO: 15023 - protein, 590 aa, Homo sapiens; identical to SEQ ID NO: 15021
  Payload ID: 2937
  Gene Symbol: CHRM3
  Gene Name: cholinergic receptor, muscarinic 3
  Uniprot ID: P20309
  ENSP ID: ENSP00000482377

SEQ ID NO: 15024 - protein, 479 aa, Homo sapiens
  Payload ID: 2938
  Gene Symbol: CHRM4
  Gene Name: cholinergic receptor, muscarinic 4
  Uniprot ID: P08173
  ENSP ID: ENSP00000409378
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 15025 - protein, 532 aa, Homo sapiens
  Payload ID: 2939
  Gene Symbol: CHRM5
  Gene Name: cholinergic receptor, muscarinic 5
  Uniprot ID: P08912
  ENSP ID: ENSP00000372750
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAAQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 15026 - protein, 22 aa, Homo sapiens
  Payload ID: 2939
  Gene Symbol: CHRM5
  Gene Name: cholinergic receptor, muscarinic 5
  ENSP ID: ENSP00000452742
MEGDSYHNATTVNGTPVNHQPL

SEQ ID NO: 15027 - protein, 532 aa, Homo sapiens; identical to SEQ ID NO: 15025
  Payload ID: 2939
  Gene Symbol: CHRM5
  Gene Name: cholinergic receptor, muscarinic 5
  Uniprot ID: P08912
  ENSP ID: ENSP00000453745

SEQ ID NO: 15028 - protein, 502 aa, Homo sapiens
  Payload ID: 2940
  Gene Symbol: CHRNA7
  Gene Name: Cholinergic receptor, nicotinic alpha 7
  ENSP ID: ENSP00000488147
MRCSPGGVWLALAASLLHVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 15029 - protein, 482 aa, Homo sapiens
  Payload ID: 2941
  Gene Symbol: CHRNA1
  Gene Name: cholinergic receptor, nicotinic, alpha 1 (muscle)
  Uniprot ID: P02708
  ENSP ID: ENSP00000261007
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 15030 - protein, 457 aa, Homo sapiens
  Payload ID: 2941
  Gene Symbol: CHRNA1
  Gene Name: cholinergic receptor, nicotinic, alpha 1 (muscle)
  Uniprot ID: P02708
  ENSP ID: ENSP00000261008
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 15031 - protein, 377 aa, Homo sapiens
  Payload ID: 2941
  Gene Symbol: CHRNA1
  Gene Name: cholinergic receptor, nicotinic, alpha 1 (muscle)
  ENSP ID: ENSP00000386611
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKAAAEWKYVAMVMDHILLGVFMLVCIIGTLAVFAGRLIELNQQG

SEQ ID NO: 15032 - protein, 269 aa, Homo sapiens
  Payload ID: 2941
  Gene Symbol: CHRNA1
  Gene Name: cholinergic receptor, nicotinic, alpha 1 (muscle)
  ENSP ID: ENSP00000386684
MEPWPLLLLFSLCSAGLVLGSEHETRLVAKLFKDYSSVVRPVEDHRQVVEVTVGLQLIQLINVDEVNQIVTTNVRLKQQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGGCGCHDCCC

SEQ ID NO: 15033 - protein, 375 aa, Homo sapiens
  Payload ID: 2941
  Gene Symbol: CHRNA1
  Gene Name: cholinergic receptor, nicotinic, alpha 1 (muscle)
  ENSP ID: ENSP00000387026
MEPWPLLLLFSLCSAGLVLGSEHETRLVAKLFKDYSSVVRPVEDHRQVVEVTVGLQLIQLINVDEVNQIVTTNVRLKQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 15034 - protein, 81 aa, Homo sapiens
  Payload ID: 2941
  Gene Symbol: CHRNA1
  Gene Name: cholinergic receptor, nicotinic, alpha 1 (muscle)
  ENSP ID: ENSP00000395805
MEPWPLLLLFSLCSAGLVLGSEHETRLVAKLFKDYSSVVRPVEDHRQVVEVTVGLQLIQLINVDEVNQIVTTNVRLKQCRW

SEQ ID NO: 15035 - protein, 450 aa, Homo sapiens
  Payload ID: 2942
  Gene Symbol: CHRNA10
  Gene Name: cholinergic receptor, nicotinic, alpha 10 (neuronal)
  Uniprot ID: Q9GZZ6
  ENSP ID: ENSP00000250699
MGLRSHHLSLGLLLLFLLPAECLGAEGRLALKLFRDLFANYTSALRPVADTDQTLNVTLEVTLSQIIDMDERNQVLTLYLWIRQEWTDAYLRWDPNAYGGLDAIRIPSSLVWRPDIVLYNKADAQPPGSASTNVVLRHDGAVRWDAPAITRSSCRVDVAAFPFDAQHCGLTFGSWTHGGHQLDVRPRGAAASLADFVENVEWRVLGMPARRRVLTYGCCSEPYPDVTFTLLLRRRAAAYVCNLLLPCVLISLLAPLAFHLPADSGEKVSLGVTVLLALTVFQLLLAESMPPAESVPLIGKYYMATMTMVTFSTALTILIMNLHYCGPSVRPVPAWARALLLGHLARGLCVRERGEPCGQSRPPELSPSPQSPEGGAGPPAGPCHEPRCLCRQEALLHHVATIANTFRSHRAAQRCHEDWKRLARVMDRFFLAIFFSMALVMSLLVLVQAL

SEQ ID NO: 15036 - protein, 96 aa, Homo sapiens
  Payload ID: 2942
  Gene Symbol: CHRNA10
  Gene Name: cholinergic receptor, nicotinic, alpha 10 (neuronal)
  ENSP ID: ENSP00000432757
MGLRSHHLSLGLLLLFLLPAECLGAEGRLALKLFRDLFANYTSALRPVADTDQTLNVTLEVTLSQIIDMVRCGGGTAVESYLSQCQEMKGMNGTRC

SEQ ID NO: 15037 - protein, 123 aa, Homo sapiens
  Payload ID: 2942
  Gene Symbol: CHRNA10
  Gene Name: cholinergic receptor, nicotinic, alpha 10 (neuronal)
  ENSP ID: ENSP00000437107
MCGRAALQPAWRTSWRTWSGACWACRRGGACSPTAAAPSPTPTSPSRCCCAAAPPPTCATCCCPACSSRCLRRSPSTCLPTQARRCRWASPCCWRSPSSSCCWPRACHRPRACRSSGSTTWPL

SEQ ID NO: 15038 - protein, 514 aa, Homo sapiens
  Payload ID: 2943
  Gene Symbol: CHRNA2
  Gene Name: cholinergic receptor, nicotinic, alpha 2 (neuronal)
  Uniprot ID: Q15822
  ENSP ID: ENSP00000240132
MGPSCPVFLSFTKLSLWWLLLTPAGGEEAKRPPPRAPGDPLSSPSPTALPQGGSHTETEDRLFKHLFRGYNRWARPVPNTSDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 15039 - protein, 529 aa, Homo sapiens
  Payload ID: 2943
  Gene Symbol: CHRNA2
  Gene Name: cholinergic receptor, nicotinic, alpha 2 (neuronal)
  Uniprot ID: Q15822
  ENSP ID: ENSP00000385026
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 15040 - protein, 507 aa, Homo sapiens
  Payload ID: 2943
  Gene Symbol: CHRNA2
  Gene Name: cholinergic receptor, nicotinic, alpha 2 (neuronal)
  Uniprot ID: Q15822
  ENSP ID: ENSP00000429616
MAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 15041 - protein, 50 aa, Homo sapiens
  Payload ID: 2943
  Gene Symbol: CHRNA2
  Gene Name: cholinergic receptor, nicotinic, alpha 2 (neuronal)
  ENSP ID: ENSP00000429953
MGPSCPVFLSFTKLSLWWLLLTPAGGEEAKRPPPRAPGDPLSSPSPTALP

SEQ ID NO: 15042 - protein, 108 aa, Homo sapiens
  Payload ID: 2943
  Gene Symbol: CHRNA2
  Gene Name: cholinergic receptor, nicotinic, alpha 2 (neuronal)
  ENSP ID: ENSP00000430422
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTN

SEQ ID NO: 15043 - protein, 154 aa, Homo sapiens
  Payload ID: 2943
  Gene Symbol: CHRNA2
  Gene Name: cholinergic receptor, nicotinic, alpha 2 (neuronal)
  ENSP ID: ENSP00000430612
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNRTAR

SEQ ID NO: 15044 - protein, 81 aa, Homo sapiens
  Payload ID: 2943
  Gene Symbol: CHRNA2
  Gene Name: cholinergic receptor, nicotinic, alpha 2 (neuronal)
  ENSP ID: ENSP00000430856
MGPSCPVFLSFTKLSLWWLLLTPAGGEEAKRPPPRAPGDPLSSPSPTALPQGGSHTETEDRLFKHLFRGYNRWARPVPNTS
